United States Patent 7,745,391 (HUMAN THROMBOSPONDIN POLYPEPTIDE) - sequence listing, part 149

SEQ ID NO: 385114 - DNA, 963 bp, Homo sapiens
  misc_feature (388)..(388): n is a, c, g, or t
  misc_feature (404)..(404): n is a, c, g, or t
  misc_feature (414)..(415): n is a, c, g, or t
  misc_feature (417)..(417): n is a, c, g, or t
  misc_feature (423)..(423): n is a, c, g, or t
  misc_feature (429)..(429): n is a, c, g, or t
  misc_feature (433)..(433): n is a, c, g, or t
  misc_feature (439)..(439): n is a, c, g, or t
  misc_feature (441)..(441): n is a, c, g, or t
  misc_feature (445)..(445): n is a, c, g, or t
  misc_feature (459)..(459): n is a, c, g, or t
  misc_feature (476)..(476): n is a, c, g, or t
  misc_feature (490)..(490): n is a, c, g, or t
  misc_feature (494)..(494): n is a, c, g, or t
  misc_feature (504)..(504): n is a, c, g, or t
  misc_feature (510)..(510): n is a, c, g, or t
  misc_feature (517)..(517): n is a, c, g, or t
  misc_feature (522)..(522): n is a, c, g, or t
  misc_feature (526)..(526): n is a, c, g, or t
  misc_feature (535)..(535): n is a, c, g, or t
  misc_feature (543)..(543): n is a, c, g, or t
  misc_feature (593)..(593): n is a, c, g, or t
  misc_feature (596)..(596): n is a, c, g, or t
  misc_feature (617)..(617): n is a, c, g, or t
  misc_feature (685)..(685): n is a, c, g, or t
  misc_feature (960)..(960): n is a, c, g, or t
tccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagnaaaatcatctgtgagntccttcaggnncncacccntagtcntganccttcngngggnatatgcactggcgngtttaaagtaagggctntgatatttgatggncccnaagtacggcngctgcnaaaagtngtggnaggnaattgtctncgtgtctnggaaaaattagttaggaatttggatgggtaaaaggtacccttgccttacnccntcttattttcttagccccctntgagtgttttaactggtttcatgtcctagtaggaagtgcattctccatcctcatcctctgcccccccnggaagtcagtgattgtctttttgggcttcccctccaaaggaccttctgcagtggaagtgccacatccagttcttttcttttgttgctgctgtgtttagataattgaagagatctttgtgccacacaggatttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattantaa

SEQ ID NO: 385115 - DNA, 748 bp, Homo sapiens
agtctcagattggtaaacacccgaactggtcaactctcaagagaccatctggttcaggttcctgactgggccagcgagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggatgcccagcgaatgaggggtagagccactctggggcccagcctgcctgccgcacccctgtggcctcccttgtggatgggaggaggcgggatctgctctgaggccctcgaggctcagcagagcgtgcaccaatgagaccacgatgggaaagggcctatttaactcctaataaaaaactggcatcaaaaaaaat

SEQ ID NO: 385116 - DNA, 967 bp, Homo sapiens
agatgatgcagcaagaaggccttctccaggtgttaccccctccagcttagacttcctggcctccagaatggcccagagatatgaacaaggcttctcatgtgcagttcctccaggacggctcctcaaaagtggttcctcttgacctgaagtcctgtgaagaacatagtcgatgttcacagtgtcttgctctgttgcccaggctggagtgcagtggcacgatctcagctcactgcaaccttcgtctcctgggttcaagcgattctcctgcctcagcctcccgagtagctgggattacagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccgactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggatgcccagcgaatgaggggtagagccactctggggcccagcctgcctgccgcacccctgtggcctcccttgtggatgggaggaggcgggatctgctctgaggccctcgaggctcagcagagcgtgcaccaatgagaccacgatgggaaagggcctatttaactcctaataaaaaactggcatcaaaaaaaat

SEQ ID NO: 385117 - DNA, 671 bp, Homo sapiens
aggcggaggtaatgcccttgaactgagggcttctccttctcagaaatcagaaggaagatgagctcatttatcaataaacacctacaaaatgggtcaggaagttgagataggtcaactgtatcacctcagcttttcatctcagtgcccaaggaaatcaaacttctcacttccttccccaactcctcccactcctactggactccctgccaccaacaggaccccagttccctgcagctactcacaagctcgatgaaggcttgtgtattgagtgggttgggggagatactggacaatgcaaggtggcacacagatacccagaactctacctgattcgggctttttaaatataatggtagcatctgtagggcaactaaattcataatgagaacttttccctcaaaataaacggccacatagcaaaatatttattatttacaataatgatcttcagactggagcacgcatgcccctgggagcacacagcttctctcaaaggcatatgctggccattgtctagttttaagagactcagggtttttgggctggccccggtggctcgcacccgtaatcccagcactttgggaggccaaggcaggtggatcacttgaggcccggagtttgagacccccctggtcaacatggccaaaccccatttttacttaaaaaaaaaa

SEQ ID NO: 385118 - DNA, 898 bp, Homo sapiens
aacttctaaattctaagcccacaccagacatcggtgagaccctaagaggtttccaattaaaattaagccagatgataaatggagtaatctgaagtgagtgatcactaaggttttttttggttctaatattttatgacaattgtgaaatttgagacttggccatttctggggaattacattaagtcagcacaaaaaactttaaaagggtaaaaccacatctttcagtgataaaaacagttaccaaaatcacttctgtcccactctgtctccaaactctgggtgacttcactcttacagtttatggttgtaaagtttcatttatttttgtttatctgctgtatatggtctttagcagggccttttctgaccatggaatcgtggcaactctgagagcaacttggtttcctgcgaattagctggaagggtgtaacccaagccgtcaatccaacccgcaaatagcagagtgaaatgttaggctttggtgcttcagagatgctgagtgcaagatgcatttattccagttttgttggcaaaatagcattcaaaaaacaaatgcttgtatgtgcaatccatcagaagttcagtcaaatatttgcctgactatgcactggaaacttaaagaagcagaaggtatggcggtgaactacacagacaaggaccctgctcacgtggagctttcatgaacttggtgtgggttgcagagtggaaataaaatcaataaatgaaagtgacaaatggaaattatcagttggtaatttccacaatggacacaatacaatataagctaacgtgttgggactgaagggctgtaacagtccagagaggctaggtatgctatggtaacaatctgaaagtctcagcaaattaaaacagcaaagatttctttcttgctccactc

SEQ ID NO: 385119 - DNA, 943 bp, Homo sapiens
taatacagagttgggactagaacccgggtccccataataccttcctttattggccactaggtggtgataattcgttgttaagagagaatactgttataatttaggcttaacttagatctaggatgtatagaacctgacaaatgatatgaatagatttatcagaattttgataatataagcatattatcagaattttgaagcagagagaatcaagtctttctggaactacactggagtaatttacgtggatgatctaaatatccatcatgacaggaatggttgagggaatgatggcctattaatagaattgagtattatgtaaccattaagtactacatgcacacacacataaaaagcactcagtaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaacaaaaaaaacaaaagcactcagtaagtatgtgttcaattaaaaataattataaaattttgtaattctgtagaaagactttcaaattagtattacatgaaaaaaataagatacattgaacatgtagagttagtttggtccatttgtacacatgacaattagagaatctcgtagccaagtatgaaaagaatctggtaaaccgccaatgaattaaacctatttgttgggtgggtgtacataggtgttgttaactcatgttcaagattcttgatcgacatccaaggtatttagcgctaactattacatcagcctggttaaag

SEQ ID NO: 385120 - DNA, 750 bp, Homo sapiens
ggcttaacttagatctaggatgtatagaacctgacaaatgatatgaatagatttatcagaattttgataatataagcatattatcagaattttgaagcagagagaatcaagtctttctggaactacactggagtaatttacgtggatgatctaaatatccatcatgacaggaatggttgagggaatgatggcctattaatagaattgagtattatgtaaccattaagtactacatgcacacacacataaaaagcactcagtaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaacaaaaaaaacaaaagcactcagtaagtatgtgttcaattaaaaataattataaaattttgtaattctgtagaaagactttcaaattagtattacatgaaaaaaataagatacattgaacatgtagagttagtttaactgtaaaaatgaaatttaagagaacatgtcaaaattctgtacagtacaaaatattgtaaaattttgtacaagaaacttttgtacaagaaaca

SEQ ID NO: 385121 - DNA, 732 bp, Homo sapiens
tgaaagcactaaagtggtctgtatgacatagttatccagcttattgcctgaaaaaagaagagggaaccagtgttcctagtatgaagtgaaattcttcagaaggagaatgacctaggaatttagttcagtgtctctggatgaatcattacagctttcaagcaccctgccatttgtgaagcaacagcaatactggcagaatacttcaaaggaatactgtagaaattaatgagtttatttatattatgcttaaagttcctttgaagaaattaatacatcataattcaaggagcaagaatgtttcatattatctccttgaaatcttcaacattgggaaaaaaaattgcatatgaccaatttcactgctcaaaaaccaaggtagcgaggttggccaatccatttaaggtcagataagttaaatcaaaccaaaaatggaagccaaaaggaaaatttatgtttgaattcccaaatttgcacttctagaccagaactgacagatttctgtattattaagcatctatgggatgtttatatttataaaatatttggctacaagtgtgaaagactttgcatattgatcttgcaaagttaagaataatctgattctgaataaataaccatacttggggttttaattcagggttcaaattttttggaacttttccattatgtatagtaataaatattcagatacatggatattaaaagatttcaaaaagtgtgataatgtcaatt

SEQ ID NO: 385122 - DNA, 570 bp, Homo sapiens
ggggatgaaaactaaagtcataacttcaccagaaatggcatatatgtggcattggtgccacaactttccccatcctggcccatggcagacagcaccatcagtcagcagtttttctcactgagtccagacagccacactcaagcctggaggatttgggttgggcatttaagattctcagaggcaggggatggaggtggagggaccagactctttcttaggtaactagttaggcattataccaatgaatcatggccaagacgtggagagcagttgaagacatttgaatgttaaaagataagaaattagcatgtgaagtgttaaatatttagttctctcagttttatttatacagaagaaacagaccagaaatcaggaaactttggtgtggtttcagctctgggagtggttctgggaagtccccacatatcttgcagactttagtttcaattgaaacaaatttgaactaaataataaatatgactgtaattctacagttttacaattgtaaatatagactatatgaaagactacacattttcaaattgtgtgtgtataagaatataactgagg

SEQ ID NO: 385123 - DNA, 382 bp, Homo sapiens
ttacatattcagtcctcagttccaagctttgtacgagccttctcttccgctgatttcaaagttagaaagttcaaactagtctcctctccctcctactaagtttccacttgcatattttgatgtcagtccgaatcctgtgttaatcaggccaaaattcattaacgaaggccaactgtgatctccaggaagctagctgctctccatctaacataatctgtgtttcatacagctaagtggtttctcaaacactctaacaccaagctctgaggggggaccctgtgaacaaaatagaacggctcctgtctcatggtgcctgttgcaatatgtgtgctcccgttttggggaattctgcactgcaaagtaataacgagcagtcacattg

SEQ ID NO: 385124 - DNA, 301 bp, Homo sapiens
tctgctggttgtaaagacggtagagtaaaaatgatgttatgataagaagagcaatgaaatctgctgtgcatgcaaccttcctttttgccttccttccaaagaaatctctgatgtttcttctagcattctatcaaaatgaagtcaaaatctatatgacagtaagttctctaagcagataaatcaatataatgtgcatagtaacatacaagtgacatcatttctggaaaaagaaagtttaagatatatgggacatgttgaagtctcaacatgtatgacagtattcatgttaaataattgcaga

SEQ ID NO: 385125 - DNA, 1695 bp, Homo sapiens
tgcgttgtcttggaggctgagatgtgggaacagacagatcctttgttctgaggctcactcatctcccgagccccgagccgtctcccagcctcagacggctctgcgggctgcatctgtgcagcctggcagcggcggcgctgcgctgtgacattttcacagcccttcttgcagaggcatgtgtgctagggatgccgaaatgccgagagcgccggcaggactagcttccgggccgcgctttgtgtgctgggctgcagtgtggcgcgggcgaggaagctggtagggcggttgtcgcaagctccagctgcagcctccgcctacgtgagaagactagaaagcgggcgcaggaccaggcctgcgttgtttgcagagaggccgtggctacaaaatggaagtgcttttgcgacctgggctccattttaggaattcttgcccgattttaaccacttgaacgcggaagtggctttcctattctcttccaagccagcctttaattttaaacgctgtaattaacagttcacaggggtcaaattcctttattccggaacattccactttgagagggatctgtcctctttggtcccctgcgttttcaaatatttgaggaaaggtgtcgcctctttttctgtggaaagaggaagctcatgagcgcgaaacagcaggggacggagggcgagaagggctttctcaggttgcgggtcggagggcagaagcacagttcccagtacagagacccggacaggtggctgtttctcacgctcactttggattgctccctacggcttcctccgcagccatgtctgacaaacctggtatggctgagatcgagaaattcgataagtcgaaactgaagaagacagaaacgcaagagaagaatccattgtcttccaaagaaactatcgaacaggagaggcaagcaggcgaatcttaaacaggcatgtgccaccaatatctactgtacattctacaagcattgctttcttattttacttcttttacttgtttaacttggttagatgcaaacacgttggatgagtttgaaaggactatgctgcccttttgacatcaaagacctgctgacaatggaggccacgcctgcttctcccatcgcctgtctggctggcagggaaggaaaatagcttgaatgttggtgaaagacttagcggagtgggagggcagtgaaatctagagtaaaaccaagttgggccaagtgtcctgcagaatctaaaatgaagtttaatcagcgtgccatttttgttgttgtttgaaagattttaatttttggaatgcacagtttttatttaaaaaagacatttttaaaccactgcttgtgagattgcttgttgattggaaagagtgttttattcaccatttaaacgtttgcaaagtggcgtgccccttggcctcacaggcaaagaataacttaaaagctgacgatttgaataaattatgttacagtatgaaatatgttttacctggatatgtaaaataccttctttattctagctaattgggagatgattttttttggctaattgagattacctttagattatgttttcaaaactggcttatactgtaatctacaactaataagcactaatttagagttcagctatattgttgcatgtagtgagaagggacttaattacaaacttaagacgtaagtgtgcaataaagtaagctaagaagaaaata

SEQ ID NO: 385126 - DNA, 203 bp, Homo sapiens
aattgcttatactccttgcatttctggaacaatgctacaagaagcattttcaggcattgtcaatgtatttgctgaaaaatgattctgaagttaaagtacgttatacttcttagtgttccaagtgaaaaccaatactagaaaaactactttcctgaaggaattggcacactctctactttaaaaaactttttttaagttccggg

SEQ ID NO: 385127 - DNA, 445 bp, Homo sapiens
ttgatctgtcatccaggctggggtgcagtggtgcaatcccagctcgctacaacctccacctcccaggctcaagccatcttcccacctcagcctcccaagtagctgggaccacaggtgtttgccaccatgcctggcaaatttttatattttttgtagagacagggttttgctgtgttgcccaggctggtctcctaatgcctgtcttcaagtgacccacccaccttggcctcccaaagtgctgggattacaggtgtgagccaccacatctggcctgaaaagactcctcttaatcttaagcatagattggacagaaccagagtaaaggaaggtgatagatgaattggaagattattgtagcagtctaggcaagaaatgtactagctgagagtatggttggaatggagaaaatggaaagagctggacgtacttgagaagtaatttggga

SEQ ID NO: 385128 - DNA, 1418 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccac

SEQ ID NO: 385129 - DNA, 1566 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccac

SEQ ID NO: 385130 - DNA, 353 bp, Homo sapiens
aataaaaaattcatgtactctgaatcctttagtttcctcagaaggccatgaagccccagacaagccagaagcaattattcccattttaaggacattcgagcctgcatacaattgtaatacaaaccaagcaaagctctttcagaaggcacaactctacttcatgatccatgaaaaactggttttaatatttgcatgcatcttcttcctatgaaggtctgtttgaactggatatttctatagcatgcacaaatgatagattgttatgatcaattaatattcaaaatttcccccagagagagagagagaatgagaggtagaatcactcacaggtacagaaagaactaccattataa

SEQ ID NO: 385131 - DNA, 742 bp, Homo sapiens
cacatatgttaaacaaaaacactaatgctttctatgaacaccccattctctggtgctttatcagacttgccaactcattaattagagctattgaaaagaattccgtctatagacctcatgggcagagattacaatgcttggtttccccattgatttttcatcaatcggactaacagtagcaaatcattgagagtcagagttggggtaaagattccagggaaagcgaacatttgtaaattgtgttcctttgggaaaaataataataacgataattaaaatagtaaccaacttttgaacacttactatgcaccaggtgccatgtttcatttatgttatctcatttaatattcacaacaagccttgcagtagttacaataatcggttcacttctaaaaatgagaatccaaggttcccagaggcaacgtgaacttttgggtctaatctttgtttaaagtcacactgctagtaagtggggaacctggaattcaaacttaggtctgtgtgctccagagtccatttgtaatcaatataactactagcctccagtaatgtcaaatgtatgagaaaaataaagattactcataacattttcaggatattccccaccaccacacacacacctttaaaactagcaatgctgacccacattcattaggatggtaagcattattagggacatacaggtttcacacttaccatttaaaaagctaaatgaagtgcccaaaatataaaatggccatcc

SEQ ID NO: 385132 - DNA, 1562 bp, Homo sapiens
cccccccccccaccctagcgctacggtcgaggctgcgctggttactcgcccgcaggcgcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385133 - DNA, 787 bp, Homo sapiens
ggacgcgtgggtcgacccacgcgtcgagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagacaagagattgaccgactgtctcctctcgccgcagcgg

SEQ ID NO: 385134 - DNA, 1669 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385135 - DNA, 1530 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctcatacgcgatcctctctgctaacatgctgccctcacgtagttatctcgatgtcatgtg

SEQ ID NO: 385136 - DNA, 2405 bp, Homo sapiens
gggattgtttacgtctcgctccggggcggaaagtgggtcagggccgggccggcggagcgcgcagcgggggctgcaggtgagtggcggggcacgggccgacgtctcgggctctgggcgggcgcgctgaccttgcgggcgcggcggtagcagcgcggccagggcgccgcctttgttcctctccggagggccgcgcccgagagaggcttccccggtgccgccgactccggaacccgcgcgcccgcgggagggaacagccaggccgggctgccgccggggagggcggctcccgctgcacacgcgctcgcctggggctgggcagggttcggcggtccgggcgccgcgatccgccccggcctccctggaaccccacccggggcccagcgggcgttgccagccgcgagcccggcgcaggggtcggccctggaaggctaggcgggaaccccggagctggcgagggaggtgccaggcaggtggcctgggaagcgcagacctggccctcgcagccttttgcattttataccataacagcggccagcgctgagcaggttttaagatttgtgtttcacgaggagccctggcggtagcgagcggaggggaaggcgagctgcgcggcccaggagacggtggcgggaggaggatgcaggcgggtgcggcggtcgggccgggggtgaggggaaggtgtcggggagcggtcacggtgcttctggcatgaggaactgggaggccggagatgccatttgtcaaaccggacgacagaggaggagcgagtggaggttttagatgcctgcgggacaggcgggcggggcagccagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385137 - DNA, 1754 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385138 - DNA, 1629 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385139 - DNA, 1029 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctaccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385140 - DNA, 1163 bp, Homo sapiens
gttttttttttctgggtggcgtttcacaggatctacctgggttttattgagctgctcagatcctggggtgaggtacgggctcctgaagcgttctggagccctggctgggcaccggtgcggcccctgcagtccccactttgagtgggtccgtggcccagcctggaagctcagggctgggagtgctgtgagtcttcctttgcccagagcctgtgttttcttctagattctttccaccatggccagacgcccccggaacagcagggcctggcacttcgtcctgagtgcagcccgccgagacgcagatgcccgggccgtggctctagcaggctccactaactggggctacgactctgatgggcaggtaggttccagcgggcgaggcggacgtggctggcctaaggtgtggagatgccctaggcaggcaggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctgtttgtttgttttttaacacacatatatgtgaacaaagagtatgcgtttgtactggcagaagaagcgtctggtaagacaaccagcaagttaacaatggtcacctccagaaatgggctgggtaaaacaaaaaaattctttggtttacc

SEQ ID NO: 385141 - DNA, 127 bp, Homo sapiens
cgacaagaccagcttctcgtcgcggttcggccagggctccatcattggcgtgcacctggacacctggcacggcacactcacctttttcaagaacaggaagtgtataggtgaggccgtcacaggactt

SEQ ID NO: 385142 - DNA, 741 bp, Homo sapiens
ggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatgtgtgtgttaaaaaacaaacaaacagaaaaaccctgatccttgaaggtaaaaatttctgcacttgctcagcgaggccaggaacctgaaggtattcagaacagctcaggtgtttgtctgtctgcagcccaggtgatctgacatgcttgtgggctttgcaggcagagctacctgcccccatggcccttgacccccaccttggcagaccctgag

SEQ ID NO: 385143 - DNA, 961 bp, Homo sapiens
gttttttttttctgggtggcgtttcacaggatctacctgggttttattgagctgctcagatcctggggtgaggtacgggctcctgaagcgttctggagccctggctgggcaccggtgcggcccctgcagtccccactttgagtgggtccgtggcccagcctggaagctcagggctgggagtgctgtgagtcttcctttgcccagagcctgtgttttcttctagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagccccgcgccctctgcctggcccctgttcctagatggtgggcatcgggacgtcggatgtggacctggacaaataccgccacacgttctgcagcctgctgggcagggatgaggacagctggggcctctcctacacgggcctctcaacaaaagggaaagacagttctcgtcggggtcggcaggc

SEQ ID NO: 385144 - DNA, 1556 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385145 - DNA, 2292 bp, Homo sapiens
gggattgtttacgtctcgctccggggcggaaagtgggtcagggccgggccggcggagcgcgcagcgggggctgcaggtgagtggcggggcacgggccgacgtctcgggctctgggcgggcgcgctgaccttgcgggcgcggcggtagcagcgcggccagggcgccgcctttgttcctctccggagggccgcgcccgagagaggcttccccggtgccgccgactccggaacccgcgcgcccgcgggagggaacagccaggccgggctgccgccggggagggcggctcccgctgcacacgcgctcgcctggggctgggcagggttcggcggtccgggcgccgcgatccgccccggcctccctggaaccccacccggggcccagcgggcgttgccagccgcgagcccggcgcaggggtcggccctggaaggctaggcgggaaccccggagctggcgagggaggtgccaggcaggtggcctgggaagcgcagacctggccctcgcagccttttgcattttataccataacagcggccagcgctgagcaggttttaagatttgtgtttcacgaggagccctggcggtagcgagcggaggggaaggcgagctgcgcggcccaggagacggtggcgggaggaggatgcaggcgggtgcggcggtcgggccgggggtgaggggaaggtgtcggggagcggtcacggtgcttctggcatgaggaactgggaggccggagatgccatttgtcaaaccggacgacagaggaggagcgagtggaggttttagatgcctgcgggacaggcgggcggggcagccagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385146 - DNA, 1703 bp, Homo sapiens
gttttttttttctgggtggcgtttcacaggatctacctgggttttattgagctgctcagatcctggggtgaggtacgggctcctgaagcgttctggagccctggctgggcaccggtgcggcccctgcagtccccactttgagtgggtccgtggcccagcctggaagctcagggctgggagtgctgtgagtcttcctttgcccagagcctgtgttttcttctagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385147 - DNA, 1413 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcacccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385148 - DNA, 1577 bp, Homo sapiens
agcggggtgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggtgcgtgaggcccagggtggggcggggccgagcctggagctcccgggctcactgcgaccctggctgcccccaggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacacccaaatgacgtgagctga

SEQ ID NO: 385149 - DNA, 870 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcgtcgcggttcggccagggctccatcattggcgtgcacctggacacctggcacggcacactcacctttttcaagaacaggaagtgtataggtgtggcagccaccaagctgcagacaagagattgaccgactgtctcctctcgccgcagcgg

SEQ ID NO: 385150 - DNA, 772 bp, Homo sapiens
gggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtgtgagcgtggggcccagcccctgctgggactgcactgcgggcgggcctgggggtgggcagggcagagccccatggagctctcagggctgccccagcctgggcctctcttgcagatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatggtaagttgcttcggcccagggtgcttctggggaacctggctccggcagcccagcctcgtgggggatcctgctagagtcg

SEQ ID NO: 385151 - DNA, 869 bp, Homo sapiens
  misc_feature (1)..(1): n is a, c, g, or t
  misc_feature (5)..(6): n is a, c, g, or t
  misc_feature (9)..(9): n is a, c, g, or t
ngcannagnccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggaaaaatgtt

SEQ ID NO: 385152 - DNA, 1415 bp, Homo sapiens
tttccctacacattagctggccccttttatgaccaatgactcataaggcaagatgtgtggtggcatcttcggacaggcagcaggctttaatagggcagcctgggttggtggaggcaagcaaagctaattggcatgcgtgggaatcaaaccccaggccctgggctcattagcccatggtcaaaacaactgagccagaggaggtaataatttgcccaagaatatcagtagttcctttattagaagaaaatggctgatatggaagttggggaatctgaattgccagagaatcttgggaagagtaataagctcttagtctcaacaaaaagtgttttttcatctcagcgcgtaaagggtgctatatgggaacaaagaagtattttaaaattataactactcattctttctttagccttagttaatttgagcagaagccacaacaagcaaaccacaataaatttagaattggcagaaatccacattaactcctcttcccaagtttccacactactaccatttacagttgtaggtttgtaatgtataattatgtaatgcagaaactagctttgacttgtgtaacgatgcactgtcaaagtaagcaaagtaagaattgaaattccacattcccagaatttaacactcagctgctcctctagtaataagttcctggggataatacattaaccaacattggttgaaacatacctgagtaatcatatcaggatgcatgttaagctgataaaacaataagatcccaaaatgcagtagctcaaaaaaaagtagaagttaatttatctcctgggggacagctctggttctcaaattttacaggctcagaatcacctgcagggcttgtgaaagtacagattgctgcgctccgcccccagagtttctgatttagtaggtgttaggctgaaccaagaatttgcctttctaacaagctcccaagtgatgctgatgacttgtaggaatggatttacttctaggattagacttcagctcactctgtttgctgaactctttctaatatttcttaagttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggaaaaatgtt

SEQ ID NO: 385153 - DNA, 630 bp, Homo sapiens
tgcggccgccaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatttggtagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggaaaaatgtt

SEQ ID NO: 385154 - DNA, 302 bp, Homo sapiens
caatgcagttttagagtgctcattctttcaacttatttgacaaatatttactgaatgtctgccataaggcagtaaaggcacagaatgactcaaagcctttttgcccttatggggtgtaatttctagtggtggagacagacaatgagcaagtaaacaatcaatcggctaatgataactactgtgaagaaaataaagcaggacaagggaatagagtatgccatcattaagactggttagggaaagcttctttgaagacatggcagctattgaaaacctgactgatacaaagaagcaagtcatgt

SEQ ID NO: 385155 - DNA, 263 bp, Homo sapiens
tgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgc

SEQ ID NO: 385156 - DNA, 534 bp, Homo sapiens
aagagttttatgcaaaaacttatacaaaaatttacactcttaccagcagaaagcctcagcgccactgagtgctgttgtattgttaatcttgattaatctggtatgtgaagaaggatgtttcaatgttttgtctgtgtctctctgattattttgcttgttgattggccagttgttaattctgtctttgtgagttgtctttttctcagtacttggcctatttgtctttgatttgaaaaagctctttatgttgtagtcattttaattcctgtcatatgttttgtaaacaatttttcgagttcataatttttcaatcttgtttgtattatattttgccacacaaaaattttaaatttgtatagtcaaatttatcagtctttttccttatgttggaccttctaatctcaaggtactaaatataatctagcatttttttaaacattaaaaatttttaatccatctataatttattttaggatagggagtgaggcaggggaaggtatctttttaaataaaaatcgttgctaaatggtaggc

SEQ ID NO: 385157 - DNA, 564 bp, Homo sapiens
ctcataagtttgttggtctcatatatgtcttctttagaaaagtgactattcatgccctttacctactttttaatgggattctttttttctcttataaacttgtttaagttccttatagaggctggatattaggcctttgtcagatgcgtagtttgcaaaaattttctcccattctggaggttgtctgtttactctgttgacagttttttttttgtttttttttttgctgtgcagaagctcttaagtgtaattagataccatttgtcaatttttgtttttatcatgattgtttttggtgtctttgtcattcaaaattgacatagaaaattctcacattgttgcagcattttaaaaaatctgttactaagtataatatacactaagaccctaatttggtttactaattttttttaaaggaaacacaccatatgttgataaaggtttatctaggcagttaagattatactaacttttattttttctttgtatcacctaaattttccacagtaaacaattttttataatctgctttttttaaaaaataaaacatagtaggaagtcatt

SEQ ID NO: 385158 - DNA, 279 bp, Homo sapiens
gttaacacagttcttttcatatatgcaacatgaggggatggaggaatgttagagccctgtgcttaagagactcccatgcttctctcaaatagaaaaacaatttataatttttattgacttactgagtgttttttttccttctttttgtctctttgaaagggagcaaaattagggccacgaagatcaagttaatgggagtattttcatagggagaggaaggctgcaatgccaggaaagctgtgacccttgacttgttgcatgctggagtaattcggttga

SEQ ID NO: 385159 - DNA, 524 bp, Homo sapiens
gagttttggggattatgacattttgacaatgtacaggataacatctcatgtccatctcaccaaggtccttcctgctctgcccttggtttcccctccattctcacctctcacttcccttccctgcccctttgcagactcaccacccctcatgccccagaacgcttttcaaaccctttagaaatgggctgttttctcttcaggaaggccttcccctgctgtacacctggcaacctccaagtcatcctacaaactctgatcaggtgacagccccaatcccctctctctaacctgcagccttggcggctccttctcctgaatgtgctcacagtaggttttataggccatcattgcagcaattgtgcataatggctagtttgtctgtgcttctctcctccacatttgcttacaagcacttcgacgcccagagcataaggtttcatctttgtacctgccagttatctaaactggggcctggtacacagtagccattcaaatgtttgttgcatgaataaatgaatgaagtc

SEQ ID NO: 385160 - DNA, 457 bp, Homo sapiens
acacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcctttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttc

SEQ ID NO: 385161 - DNA, 466 bp, Homo sapiens
tgggcattctattctaaatgtggcttcctatactgattacatggagcaattagctgattaatcctctcctccatggagaggctgtgaaagcagaagaaacagcagcagttcacaagtttcatgagggcaaattagttcctctgtcccccagcataccagaaaaagcagcagttcctcaaaatgaagatctacattaatcagacacttctgtgacacaccactcctcagccaaatgttgaaaagctttgagtactctcaaggtacccctaaggagtgccttccctgcctaaaagagtgtcataaccacttaggggactttctttaaggatgagaacatttcaactggcagccaattatcaaggacatctagtacagcttgaagcagaacatatttgttttttgtgtttgtcttaaaaagacattcatcagccatcatgtcttttggttgcagaaaagcagagacctg

SEQ ID NO: 385162 - DNA, 968 bp, Homo sapiens
ctagtcagcacaggcaatggtagcaatcacaaatctcagtcaaaatatcgcagtgttggctgggtgcagtggtcacacctgtaatctcagcactttgggaggttgaggtagtgcggatcacctgaggttcaggagctcgagaccagcctggccaacatagcgaaaccccatctctgctaaaagtacaaaaattagccgggcatggtggcatgggtgtgtactcccagctacttgggaggctgatgcagcagaatcacctgaacctagaaggcagaggttgcaatgagcaaagatcataccactgcacccagccactgcctctacttttatacctatgtgtgttccttgccccccagtttattaatttatttggggactttctttagcatctgtcactctgctctaagatacagtagaacagcttttgtgagcctccaaatctcccatttaagaacagagtctccttctattctagtgatatttaaactcagaaatcataactggcctttagattgtcatgttctgtttacacagtgtatatgatgtatttttttttttttttttactcctttcaacagagctaaactcttcttgctcctttcaatgatgtagtgaagtaggattcattttctccagtttatggagagaggaaacaggctgatgagatgtaacttgtcagtggtcgtattagtaaatggagttgttgggacctgaacaaggtcttctgatgtaatccgtggttcttttgtagtctggaaagccgctgcctaaggaagaggtggcagtgctgattcaggtggtcctttgccattccaaaagaaagctggattgccttaccaaatctccaggtttttcgttatacctcttcactcaggctctgcccagaactcaaggtttgttttcatttttaaagcagttttttttttcatatttgaaatttacacttcctgtgtgtctgtgactagatt

SEQ ID NO: 385163 - DNA, 668 bp, Homo sapiens
  misc_feature (1)..(2): n is a, c, g, or t
nngggaagtcttttgagaatatttgttctcttattttttgtttgtttgttgctggcaaaaaaaaaagtaactttaaaaactcagaaaagccactgaactgtattttgtgaccttatgattagttttatctttcaactgatttttattgttacttttactcaatatcaacagtacttcaatagatatttattagttatgttcaatctaatgacttaaaacagttgaaaaggaggaaaatcaactccagtccacacatacagtcatgttacattaagatgtcatgttgtatgtcacacagtttctagattgatttctcttgtgtataagttataacatcaaaaatgccaaagggtatataaaataagctacaataatattcaacagaacttaacctggaccttatgttgtaataatttattcatattagctgtagtcttctgtatttatattttcagtatttattatgaatgacatggaaattcgtgtatttattgtggctttttattgcagtgtgtatatatatataacaaataagcatttttaagtcttatccttaagtttcttttattagtggcacttgtattatgctgtactttttattacatattgtacaatatcttgtccatttgtttgcagcagagtaaaaccggtttctaagttgtaactac

SEQ ID NO: 385164 - DNA, 275 bp, Homo sapiens
gacaagtaatttgggtttattctgagacttctacttctgaattctctactacaggttgtatgccacagtgattaagattagtttccaggaagacagcagaaagaattgaaattctgggaaattcctcttcatgttcctgtttttaaaaattcctttctgaggagccaggggcttgtgccgtaatcctgataactcaggaggctgaggcgggaggatcacttggggccaggagttcaagaccagcctaggcaatgtagtgagacggtgtctgtaaa

SEQ ID NO: 385165 - DNA, 778 bp, Homo sapiens
gacttctcttataggctgaaatgcatgaactgttaatcagaaatctctttcccctgagattaaaaagctgtagctgttggccttcttcacctctttccttctgcctcagtagtttgcatctgttattccctctgcctggaacagactctgttccccccaccagcccctccaagatatgctgccttggaaacttccttgactacttctctctcagctggatgaggttctttgttctatatgcagtcacagcaccctgtgcttttccttcaggacccttgtcatagtcaataattacagtattatatgactttttttgtttttttgatgtgatgccccactcgacaatcccgattctctaaggggtaaagtactttctcagaggcaagagagaagcagaatcttttagggtttagtttgaaaaaaactgtctgatctgggaaagctcacctttccctgttttgagaatcattgctttaaatttttattttcaaaggcatcaaataataaaataatctactggatatagcttcagagttaccaagaataaaaaaaaattccaaatgaagttatttttgttaatttatttatataaaaagaaggcagattttaagattttgttgaagctttaaatttgaaagaaacctagagattattcagacaacagcatatcactgtaggaattccttctgtttcttaattttattctgattgttatatcctggcaatgtaagttgtacaagaaaggtcttcctttatcactttggggaaaatggctcaa

SEQ ID NO: 385166 - DNA, 356 bp, Homo sapiens
agagtggaggagatggtgttctcgtgttaattgaggctgagaaagcagcactgctcacgttttgctttattttcttcctctcctaggcagaatcagtgttacatttgtggtcagatgagctaacgacatccttcctgacttctttctcagaattaggaaaccctgattagcatttagaacctcattttcacagacttcactcattaaaacatcaagacctaggtaacgcaccactgaaatttcataatatggaggatatgtttaaatatgtttaaaatatgtatttttaactgtggttaaaatatgtttttaaaatgtttatgagtcaaaataattaaaattgccatttaacgtaa

SEQ ID NO: 385167 - DNA, 434 bp, Homo sapiens
cctaggaccccgactctggctgtggctgtggatgcttctgaacagtgctaagtggaagcccatgaaagaacagactgttctcaaggcccatggaggaaaagatgttacaagccatccctccagattcctggacaagctctgagtccctgcccagaaaccaaaaggcagaatcagtgttacatttgtggtcagatgagctaacgacatccttcctgacttctttctcagaattaggaaaccctgattagcatttagaacctcattttcacagacttcactcattaaaacatcaagacctaggtaacgcaccactgaaatttcataatatggaggatatgtttaaatatgtttaaaatatgtatttttaactgtggttaaaatatgtttttaaaatgtttatgagtcaaaataattaaaattgccatttaacgtaa

SEQ ID NO: 385168 - DNA, 1364 bp, Homo sapiens
attcagcacgcgccccgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggaaggatctgtcatctcggagcaaaacagatcttgactgcatttttgggaaaagacagagtaagaagactcccgagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctga

SEQ ID NO: 385169 - DNA, 1287 bp, Homo sapiens
attcagcacgcgccccgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctga

SEQ ID NO: 385170 - DNA, 406 bp, Homo sapiens
gggcttcagggtgaagtcccggccctcaggcggctgcacatggtcccctgcatcctgagcagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctga

SEQ ID NO: 385171 - DNA, 1569 bp, Homo sapiens
attcagcacgcgccccgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggaaggatctgtcatctcggagcaaaacagatcttgactgcatttttgggaaaagacagagtaagaagactcccgagggcgatgccagtccctccactccagaggagaacgaaaccacgacaaccagcgccttcaccatccaggagtactttgccaagcggatggcagcactgaagaacaagccccaggttccagttccagggtctgacatttctgagacgcaggtggaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctgagcccttcagcaagagagtttaattataatcattacaaatacatgcattcatgtaagtgtgcacacgtgtgtgtgcatgtgcgcatctgtgtgtgtgtgtgtgtgtcactatctccgtttgctctcggttcccttcaataacaatgaatggtgctttcttctgaaagactcagcctaattaaaggattaagaggcaatagcttgga

SEQ ID NO: 385172 - DNA, 794 bp, Homo sapiens
attcagcacgcgccccgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagatcaaatccagagcaaggcctgtaacaatcctggtttctacatttacttaagtgaactttgctaaaggctaaaaatttctgatacaagaatccatcatcaaaactttagacacatttgcaccttcattgatatagcttactgtctctaccagcttgacagttttccctttgactttcagatctgttttgaatctgtgtgttcacattttgacatcatgttttagaactgtgatctcgcatgtaccctctcttccttaatccctcc

SEQ ID NO: 385173 - DNA, 310 bp, Homo sapiens
gcacgagaaaaatagtcttttcttacattttcccctctaatgtcttacctgccataccactgtctgctgtccagctgaactataccaggagccatatgtgttgttttaaattttctagtagctgcatgttaaaaagtcaaaagaacctgatggaagtaattttaataatgtagttaacccagtgtatgtaacatgtcaattcagcatagcaagcaatgtaaaaaagcattcaggagatatttatattcttttttttttttcctagacagtctcgctgtgtctccagcctgggcgcagtggtgcaatctca

SEQ ID NO: 385174 - DNA, 476 bp, Homo sapiens
  misc_feature (421)..(421): n is a, c, g, or t
  misc_feature (428)..(428): n is a, c, g, or t
  misc_feature (448)..(448): n is a, c, g, or t
  misc_feature (456)..(456): n is a, c, g, or t
ggggtttcaccatgttggccaggctggtctcgaactgctgacctcatgatcctcccacctcggcctcccaaaatgctgggattacaggtgtgagctgctgcgcctggcctctacagttattttcttctggggatcattttattgttggtttgtacttttctctcatttttcttttaaatacattttttactccatgaagaagcttcatctcaacctccgtcatgttttagaaaccttttatcttttccttcctcatgctactcttctaagtcttcatattttctcttaaaatcttaaggctattaaaattacgttaaaaacttaacgctaaggcaatatcttagtaacctattgactatatttttttaagtaggttgtattaaatctctgatctttcaaaggaggaaaaaaactttattcnggcgggntttccctcaaggttccggcnggcccccntcaggcaggtaggccccttt

SEQ ID NO: 385175 - DNA, 607 bp, Homo sapiens
atcttttagtcttggggaagtgtcagtgatgactgctgccaaaaactgggttggatttgtatgaagcttcgggacagggtaatccagctgatccagtgcgatgactttgacatgtaatagaccaaggaattcatttgtgtcagggtatggagccttcagcttggactgccagatgtagaagatccaatggagaattctgaggcccaaggtgattttagaactactacacggaaggagcctgcccagacatctgcactgtactgtgatctggtgcagattgagaattctagcagtttgggagaagttaaagcctctcaacagggaacactgcatttaaaggatcctgtaaactgcagcaccaggaaaaccatagtccaagtcttcattcttcagcttgcagtcacgtcaccaccatatgctgtacactagagtatttatggcttgaatcacacatggagccagtcttatctcaggcaaccatgctgtctgcatcagtataagataaaactgtgctaatgacaggagggcatgtttaaatgtacgtttccatgtatgggataaaatacttcgtcaaatgaagcttggtcaaatgaagcttcatgctact

SEQ ID NO: 385176 - DNA, 856 bp, Homo sapiens
aattgcatttcctaatgaggtagcttggaccagaaactttaatgaagatcttttttttatagccacaagtgagatataatattagactttaaactccctacccctctgtagcagacaggaacccgctggaatctttgctgggaactgtggaacaccaatttggtgcacaaggggtaagttgaagcaatgagctttcattgcagttagatgaaaggaaacaacttgtctgtgtctgggatggcatttactggatcctgaacagcccactctatgtaaaggccaaagatacccccaagctggaatttgagatactcttttggaagagaattagatgagtgactctttgaaaataaataaggattttagaggaggggtagtgattatagaaatcaggtgctttccctcttatccattataaacgaggggcctctttatagaaatggaacttaaaaaggattcaggactttatattgcaacagagcaccttaacaaatattttcttacttgatgctcacagtaactatatgaacttggtacagtggatgtccctgcgggtcagaaaaatgaaattacctttccactatcaaagctagacagggaaacagctagaacttcaactccaagtcttccaagtctcatgcactttcagatatttctttctttttttctttgttataatcaggagataaaaatgtaaaggagagtagagaaatattttaaaatgaagaaatccattacacttcctgtgtagtttggtgatatcctcatagattttcttgttccatgcaaaaaagttagtgaatagaacttcccggtctttagctggttaacacgtccacctcagacactgagtgcc

SEQ ID NO: 385177 - DNA, 2663 bp, Homo sapiens
  misc_feature (15)..(15): n is a, c, g, or t
  misc_feature (18)..(18): n is a, c, g, or t
  misc_feature (26)..(26): n is a, c, g, or t
tccatgtctgttacnccngggagtantgggatatcgtcgagccaggcctcgaggaaggccgaaagccgctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385178 - DNA, 726 bp, Homo sapiens
ctagagtatccccgcttacacctgagtagtacacttctctcctccagtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaaggtgagtgacttctcttgtagtaatcactgctcaagcaaaattacagggtgatttttaaccaagaaaatgctttcacattcatgtgacttttctgtctgatccttcctagggcatgtttttttggttattcttattaattattcagctctccatccctgtcttcgttcttgtctggctagctctccttcatgtgtcctttaccacccagcagttacccttgtgatgtgtctgcttcactttcctgagcctttgagcacaggccttctgtgtgtatctctgtataaccctccataatcaggcatgagaaatggcattgctcacccaatgttgtgcatacataatttctgtgaattctgtaataatatattttataaaggacattgatggaatatattgctaataagaatgcagattattaagaaaaattccgcacctttggggaagatggctcagagcttcctatgtgttgtggaaagctggtcagataatccctgtgcaaataggtagtcgataatcagtacactgtaggttttac

SEQ ID NO: 385179 - DNA, 3800 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385180 - DNA, 3551 bp, Homo sapiens
gaagctggggacaggtagacggaactttccgcgtggagatctttggccaagagaatgagcctcagctctgttctgtgggctgcactgagtttctcggtgtgagctggagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385181 - DNA, 3653 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaatcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385182 - DNA, 3787 bp, Homo sapiens
gtaacgtggctaacctgctgctgttccctgagcttcctgcatgacatcccaaccactcagtggtcagagcagaagtcaggctgttgccgtagccagggccaagaggagctgggatgtgatgtcctagacaaagggtagggctggtcagggatcccctgtgagagggagcgtttcccagggcaagctgctttgaaaaagaatcagagcctcctggctgcttttggttcctaaatacattttttttcaggagtatgttgagttgaataactgagattttgggcatattaccaatgctgcatctgccactggaatgctgggctactttaaaaggagttccacagagatggaattaacagctgggctaaaaaaatctgtttttcacatcctttgccctgctgcaccaaacctgcccaaacatgtgactcagctattttgcagacctaatggcatctccaagcagctcaccacagtgatgagttcctggcccacctgctcttttgtaaggagcaggatggtctgtgcctcattgttctaagaattcctcgagtgagatgtggctacttgtggagatcccaccattgacatgcatgtccccagttaagatgacccagataaatgctctgacctggttaccaccttgtggcaagcccttggatgctggtcatcttcagtcacttctttgggactgctgtccaataaatgtcaccacctttgtcctcaatgctggcagttttgtaaagaagccaagattggaggctttctatgcctggggtgaggcaaattgattaataactgtgggaggagggtggagggtgcataagccatctgtcattgctaaccgcctcctgtggacaataggaccatgatttccaagtgtccttcactaacttaagctgggggggaaaaaaactataaaggctacagatataaatctgaatggcatattgtacatgtagaaatttgtggtgttcactttttatcagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385183 - DNA, 3719 bp, Homo sapiens
  misc_feature (3571)..(3571): n is a, c, g, or t
  misc_feature (3579)..(3579): n is a, c, g, or t
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattacngatctatnggaggggggccccattcttatagatcagtaggtgtggccgggtgtgtaataatcctgaattgggggggaggtcatatgggttaaatagttttcttaaattcattgagggggaatgagggtggtcttgggatatactacag

SEQ ID NO: 385184 - DNA, 665 bp, Homo sapiens
aaagtgaaaaaaagggcacgataagtttaacatattaaatatgtattataggggctcaaagtgaagagaaatccaaaattatagggactattggtccaaggtaccccccaaaattattattaaatgtatatattgaccaaataagaagaagtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385185 - DNA, 480 bp, Homo sapiens
gctcgtaccccgaagccactgcacagtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385186 - DNA, 1890 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaaggggtaagttgaagcaatgagctttcattgcagttagatgaaaggaaacaacttgtctgtgtctgggatggcatttactggatcctgaacagcccactctatgtaaaggccaaagatacccccaagctggaatttgagatactcttttggaagagaattagatgagtgactctttgaaaataaataaggattttagaggaggggtagtgattatagaaatcaggtgctttccctcttatccattataaacgaggggcctctttatagaaatggaacttaaaaaggattcaggactttatattgcaacagagcaccttaacaaatattttcttacttgatgctcacagtaactatatgaacttggtacagtggatgtccctgcgggtcagaaaaatgaaattacctttccactatcaaagctagacagggaaacagctagaacttcaactccaagtcttccaagtctcatgcactttcagatatttctttctttttttctttgttataatcaggagataaaaatgtaaaggagagtagagaaatattttaaaatgaagaaatccattacacttcctgtgtagtttggtgatatcctcatagattttcttgttccatgcaaaaaagttagtgaatagaacttcccggtctttagctggttaacacgtccacctcagacactgagtgcc

SEQ ID NO: 385187 - DNA, 1743 bp, Homo sapiens
  misc_feature (1191)..(1191): n is a, c, g, or t
  misc_feature (1193)..(1193): n is a, c, g, or t
  misc_feature (1501)..(1501): n is a, c, g, or t
  misc_feature (1743)..(1743): n is a, c, g, or t
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaaggtacaaatttagactctaaattttaatgtctaatccccatgctgccatcttgagtgacatgtatgtattaattgtaaattatggatggattgggctttttctaatatgacataataaacactagtgggttttaaaaaaaaaaaaaaaaaaaaaaaaaaaaaaaaaaaaaaaaaaaacaaaaaaaaaaaaaacaananaaaaaacaaacaaaaaaacatttgctggcgacggcctgcggcgcccctaggagaatagggtttcttaaaagaccattccggtggggccgccgcgggcccccagcgataggttatagtgtggacgacattgggccaaaggcgtgtacccagaggagaagcacccggggacatagactatagggtgctggagtttcctccacccaaatataaaacaccgccgccgggggggacacacagaggtggttttctgtgtgaacacaaatactcgaggagtgaagagctcctcgagagagggacacaattaacgnggggagcctcatattacaacagggggaggttccaaaccgaggagaggcctagggtattctaataattttacggccccttcgcctggtggtgagataaaaaggaaagagaaagtagacaacaaagacataaaaatctaaatagagaagagtaaaaagaatagaaacgagaaaacaacacagcagagagatgaataataacatagacatagcaaatgaacatcaaaaatagacgagaacaagcn

SEQ ID NO: 385188 - DNA, 1223 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagggttttcagagttctcaagctaactcttttgcaactgacagtgtgtagctgagagagaatttttggaagacagctgctttgttttaatggtgctcagaattaaatgtgtgcttgtcgtgcattgagcaagaattgagccactccttaggattgataccagctacgaaaagaatatagctgctcttgaatgtgaggtttgttggtataaaaagtgtgtgaatttactt

SEQ ID NO: 385189 - DNA, 1351 bp, Homo sapiens
gtaacgtggctaacctgctgctgttccctgagcttcctgcatgacatcccaaccactcagtggtcagagcagaagtcaggctgttgccgtagccagggccaagaggagctgggatgtgatgtcctagacaaagggtagggctggtcagggatcccctgtgagagggagcgtttcccagggcaagctgctttgaaaaagaatcagagcctcctggctgcttttggttcctaaatacattttttttcaggagtatgttgagttgaataactgagattttgggcatattaccaatgctgcatctgccactggaatgctgggctactttaaaaggagttccacagagatggaattaacagctgggctaaaaaaatctgtttttcacatcctttgccctgctgcaccaaacctgcccaaacatgtgactcagctattttgcagacctaatggcatctccaagcagctcaccacagtgatgagttcctggcccacctgctcttttgtaaggagcaggatggtctgtgcctcattgttctaagaattcctcgagtgagatgtggctacttgtggagatcccaccattgacatgcatgtccccagttaagatgacccagataaatgctctgacctggttaccaccttgtggcaagcccttggatgctggtcatcttcagtcacttctttgggactgctgtccaataaatgtcaccacctttgtcctcaatgctggcagttttgtaaagaagccaagattggaggctttctatgcctggggtgaggcaaattgattaataactgtgggaggagggtggagggtgcataagccatctgtcattgctaaccgcctcctgtggacaataggaccatgatttccaagtgtccttcactaacttaagctgggggggaaaaaaactataaaggctacagatataaatctgaatggcatattgtacatgtagaaatttgtggtgttcactttttatcagaactaaatccggattctggggctggaggacagataaagcagaagttgttaatggttacgaagcaaaggtaaaaggaaactcttaaaataagatttaatatagctatttagcttctatgcaaatgaggaatctgttcccatttttttcatgcatctgtgccatggagatgctctggggaatgagaactgtctaatgtgtctctcacttggatgtttgattttgtcttatttgactttcagaaaatgggatagcatgccctgaggaggtctgtagctatgctaaagagaaacaatatggtagagaaatgagtacaggtaccagttgttctggtaggaatgacaagctagtcattcccttaattatttaaa

SEQ ID NO: 385190 - DNA, 2648 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatgggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385191 - DNA, 3914 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385192 - DNA, 3610 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaa

SEQ ID NO: 385193 - DNA, 4476 bp, Homo sapiens
  misc_feature (3924)..(3924): n is a, c, g, or t
  misc_feature (3926)..(3926): n is a, c, g, or t
  misc_feature (4234)..(4234): n is a, c, g, or t
  misc_feature (4476)..(4476): n is a, c, g, or t
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaaaaaaaacaananaaaaaacaaacaaaaaaacatttgctggcgacggcctgcggcgcccctaggagaatagggtttcttaaaagaccattccggtggggccgccgcgggcccccagcgataggttatagtgtggacgacattgggccaaaggcgtgtacccagaggagaagcacccggggacatagactatagggtgctggagtttcctccacccaaatataaaacaccgccgccgggggggacacacagaggtggttttctgtgtgaacacaaatactcgaggagtgaagagctcctcgagagagggacacaattaacgnggggagcctcatattacaacagggggaggttccaaaccgaggagaggcctagggtattctaataattttacggccccttcgcctggtggtgagataaaaaggaaagagaaagtagacaacaaagacataaaaatctaaatagagaagagtaaaaagaatagaaacgagaaaacaacacagcagagagatgaataataacatagacatagcaaatgaacatcaaaaatagacgagaacaagcn

SEQ ID NO: 385194 - DNA, 4091 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcttcccacatcacaaactttgaggttgatcaatctgtgtttgaaattcccgaatcttactatgttcaagacaatggcagaaatgtgcatttgcaagatgaagattacgagataatgcagtttgccatccagcaaagtctgctggagtccagcaggagccaggaactttcaggaccagcttcgaatggagggatcagccagacaaacacctatgacgcccagtatgagagggccatccaggagagcctcctcaccagcacagaaggcctgtgccccagcgccctgagcgagacaagccgttttgataatgacttgcagctagccatggagctctctgccaaagagctggaggaatgggagctccggctccaggaggaagaggctgagctccagcaagtcttacagctgtcactcactgacaaatagacctttcagcctgtgagcctctgcacaaagcagaggctgtgggctgtcacagatgctgtgtcaaccagggccctagggctaagggcctgcaccttgcgtgcatgcagcaggcaacaactgccccttctttatgcagaggtgcagaaccagggactcctgggcccatccaggctgctccctggggtggagaagggaccagggattgcaggccccatctccaggctaaggggaggagagcatcatcactttccattagctgtattggcttgcaggtcacatttttactaccagctttagacaaaaccccaatccccgcaggtttgtagataaatttttatcaaggagtgataacaagacaagttattgcagagtcagggtgcttttatatataagagcagcagccgcctttgtaaagtgtgatctatgagaattggagacacttctttactgttcaccaaagaaatgggtaatctgtgctgatctccttatttttacctttttacagggtttctaggacattgtcattattcttcctccatctatctgattccattccttccacacccagctaaagttagaggagatacatatagaatctattttagattattgttaactatttgcatcaaattaagatacacaaatggccatggatgttgccttagccttaaacattactaatagtttcacatcacctcactgcacgcatcgaaggatctgatttgaatttgtaaaggcaattcttttgagagcaggattctccaggctaaatcaaaggcagctaatcctgtccctgaaggagcagctaggggaacctgaggcttgttcttgaagtgggcaagctggccaaaatattggaacacacagaaccaaaccaggtgtgttctacacctgcatgagtgaaggatttccacgtagacacctaggaagagcccgcatgccctagactcactccagaggaaggattgatttgcaaccagaaagggagctgaaaaccacggagctccatggctcttcattcaaaagggaaaataatgattccacgttgctttttagagttcaaatcaacatctttctggataaatctattttttaacaatctttttattatttgtaaaagatataaaaacaactcccatcagtagcaatacaaggttatacattttaaccagattttctcaggccttttttggatacctttagtagttaactctcttttgtcaaaccctcttgtatataaccatcgcacaacatacagaaccctggggaatacagccaagggcactgctcactgtggcccgtgtattcattcccacaggctgcactgaaataacctggtaaacaacaccctcctccattttgcgtctatttcttctattgtgcttctttggggataggaagagaaacataactactgttccaggtaacgtctgtatcatacagttagtgttgccagtgaaacgttcccagatacaaagaattgtgcttttaattccatttcacaatctgttttgttttttttttttgtcattgtctgaccaaaattccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgctccctaaggtccttgactttctccccaggaattcacttaaaaagggactgagcattgtgtcaacctgttgcagtgtttttcatatatgtgttcactctaaaaatgcaaataaagactgcttccttagagggtgctcatacaaaaaattccagtctttgagtctttttccttttcagttttttctagtcactggatgtacccacacttcctgttacgtatgtcagtagaacattagaatgcctcacttcgctcagttcatcactgcaaaggtggcatgctcctcccagccttcctgcccaggttaacaagccccatgctgct

SEQ ID NO: 385195 - DNA, 1875 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtttacacagtaaacaatgtgaatgtgatcaccaaaatacgcacagaacatctgaccgaggaggaaaaaaagagatataaagcagacaggaacccgctggaatctttgctgggaactgtggaacaccaatttggtgcacaagggggacctcaccacggaatgtgctactgcaaacaaccccacagccatcacgcctgatgagtacttcaatgaagagtttgatctgaaagacagggacattggaaggccgaaagagctgacgattagaacacagaagtttaaagcaatgttgtggatgtgtgaagagtttcccctctctctggtggagcaggtcattcccatcattgacctaatggctcgaacgagtgctcattttgcaagactgagagatttcatcaaattggaattcccacctggatttcctgtcaaaatagaaattcccttgtttcatgtcttaaatgcacggattacatttggaaatgttaatggctgtagcactgccgaagaatctgtatctcaaaatgtggaagggacccaggctgattcagcaacaaagttgggtgagatgtgttcatgaggttgtgcagctaaggaacactcgtgcactcttggctggaagaggagattggtatagttccttgaataaaacattcggcattactgtataaactgaagatgtggatgacctagcaattcctagatgtgtaccctaaagaaagttatgcacatgagcatctggagaccccagtactgggcagcagcatccattcataacagcagaaacctggaaacgacccaaatgtcccgagatg

SEQ ID NO: 385196 - DNA, 1364 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaagacaactgggcggagttaatggaagtcaaccatgatgacaaagtggtcaccaccgaacgcttcgacctttcccaagaaatggagcgcctcactctggacttgatgaagccaaaaagcagggaagttgagcggcggctcacaagccctgtcattaacaccagcctcgatactaaaaatattgcttttgaaagaactaaatccggattctggggctggaggacagataaagcagaagttgttaatggttacgaagcaaaggtaaaaggaaactcttaaaataagatttaatatagctatttagcttctatgcaaatgaggaatctgttcccatttttttcatgcatctgtgccatggagatgctctggggaatgagaactgtctaatgtgtctctcacttggatgtttgattttgtcttatttgactttcagaaaatgggatagcatgccctgaggaggtctgtagctatgctaaagagaaacaatatggtagagaaatgagtacaggtaccagttgttctggtaggaatgacaagctagtcattcccttaattatttaaa

SEQ ID NO: 385197 - DNA, 1341 bp, Homo sapiens
cgcagaagtctgtccgcgagctgtcagcgcgggcgggaacgccgcggggcgcggggtgggcgcggccgacctggtccctgagccggccggcgaccccggacctcccgcgcgccccgcacccgaccggctcagccggccggcagcgtaacacgccctacgctcgcttgctcgccggcctcagggcaggcaggcgggcgcgggagaccccgccggggccgagacttggggcgggcgacgaggaccaggttacggcctcctcgccatgtcctcggcctgcgacgcgggcgaccactaccccctgcacctcctagtctggaaaaacgactaccggcagctcgagaaggagctgcagggccagaatgtggaggctgtggacccacgaggtcgaacattattgcatcttgctgtttccttgggacatttggaatctgctcgagtcttactccgacataaagcagatgtgacaaaagaaaatcgccagggatggacagttttacatgaggctgtgagcactggcgatcctgagatggtgtacacagttctccaacatcgagactaccacaacacatccatggcccttgagggagttcctgagctgctccaaaaaattctcgaggctccggatttctatgtgcagatgaaatgggaattcaccagctgggtgcccttggtttctagaatatgcccaaatgatgtctgtcgcatctggaaaagtggtgccaaactgcgcgtcgatatcacattgctgggatttgaaaacatgagctggataagagggaggcgtagttttatatttaagggagaaggtgagtgacttctcttgtagtaatcactgctcaagcaaaattacagggtgatttttaaccaagaaaatgctttcacattcatgtgacttttctgtctgatccttcctagggcatgtttttttggttattcttattaattattcagctctccatccctgtcttcgttcttgtctggctagctctccttcatgtgtcctttaccacccagcagttacccttgtgatgtgtctgcttcactttcctgagcctttgagcacaggccttctgtgtgtatctctgtataaccctccataatcaggcatgagaaatggcattgctcacccaatgttgtgcatacataatttctgtgaattctgtaataatatattttataaaggacattgatggaatatattgctaataagaatgcagattattaagaaaaattccgcacctttggggaagatggctcagagcttcctatgtgttgtggaaagctggtcagataatccctgtgcaaataggtagtcgataatcagtacactgtaggttttac

SEQ ID NO: 385198 - DNA, 375 bp, Homo sapiens
  misc_feature (370)..(370): n is a, c, g, or t
ggattgagtcctagaacagagtacagagaaactatgaagactgataccagccaagttacacaaaaccctaagaaaacacaaattgggagcccaaatccagtccctgctggcaaaactcattcagcaaatcctttctgttgtaaattaacctgtcatctgttttcccttccttgtgattcagatgaactattcttcctttctttgtttctaggtctcatgattcttaaacatgtatagttctttttttcttcttaaagctagtcaagtgaagcagtgtgagtggaaaaggaacaaagaaattcataattggtacagtggtacaaacaccactgtactcagatcaagcctgggcaacaagagcgaaactccnatcac

SEQ ID NO: 385199 - DNA, 441 bp, Homo sapiens
cagccgccagcagacagccgactccctcaccagtaaacaccgcggcttaggtgttgcccaccggacacggaaaggcggcccccttctcgctctccagtgaatgttcctaaaacaactgcggggtccaagagcacagggagaacagcgcccctgacgcaggctgcgcacccgcccggaggaggcagtgcgtcagtcctgaggtcaccgccacccgctcccgggggacggccgcctgggcaggtgaggaggcgaccacctcccagacgcctgccggagctgcggcgcaccgactccctgcttctccgagcggcgaacgccacctggaggctccctcgagatctgcatttaggaggcgacgggtcctttcatcgttttattcattaaacatttatcgaggcctggagcgatggttcaagcctgtaatcccagcactttgggaga

SEQ ID NO: 385200 - DNA, 356 bp, Homo sapiens
cacatgttctccctctttcaattttagcagtaatgtgatcctcaaaaatgcattaatactagttgaagtaaataaacggaagagctccaaaatgcctgcattaaatgcatttttccacactaatgccaatcatccaaagctattttcaacaagtcaggtattcaaagctattcacaccacttgaaagagtaattaccatttactgaagcacttatctgtcctacactgatgggagtaaatgcttctcataggttatctcatgtacattatgccacttcacttaaaatgatcacaaattaagtgctatagattttggttaatgctttccccaggggagttgttaaaacatgcatttc

SEQ ID NO: 385201 - DNA, 6612 bp, Homo sapiens
  misc_feature (5031)..(5031): n is a, c, g, or t
aggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacagaatgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttncagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaac

SEQ ID NO: 385202 - DNA, 4467 bp, Homo sapiens
  misc_feature (2886)..(2886): n is a, c, g, or t
gctcggtaccctgatggcatttagaccagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttncagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaac

SEQ ID NO: 385203 - DNA, 2016 bp, Homo sapiens
aggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacagaatgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttaggtctacctggccaggtagacctaacacaaggcgcttcctcttctcccagctcctaatttctcatttctggcaatccacttatagctccagagaacagttttggaaatagaacttaactcggaaaatgggaacagattaaaaagaagagatcagaaggagggagttggggggaaggggaggagtggaggcaagtgtgaaactcccctatgctacaggaagggtccacaacaattcggaagtcgctcccggctcctgccacatcgtgtgccttgccgtttccactgaaattgcagactgtagtggataatcctccagttaggtctacctg

SEQ ID NO: 385204 - DNA, 171 bp, Homo sapiens
ctcccttcgtcgcagaaatagacaagccgatcctaaaactcgtatggaaatgcaaggggcctttttgtgactgagtgtgtgtggtaggtggaacatagtagtgtccaagttagccctggtcatttaacctggtgcaatttcattgcaggagaatgacatcttcctgggctg

SEQ ID NO: 385205 - DNA, 322 bp, Homo sapiens
tctgcatgtttgtaactccacaggaaaacactgatgatttattatttcttctttgtatatagatagagtatctcacccttttggggaaaaaaaagtctttttgatgtgttgaaaattgttttaatcttaggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaata

SEQ ID NO: 385206 - DNA, 6178 bp, Homo sapiens
  misc_feature (4597)..(4597): n is a, c, g, or t
ggatcccgcgtacgagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttncagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaac

SEQ ID NO: 385207 - DNA, 853 bp, Homo sapiens
aggatgtcggcaacctaaattcatgtaccctatctgtacagttgttgtggatggtttgccatctgaaagctcctcaagttcttatccaggccctgtgtctgtttctgaaatgtctctgcttcatgctttgggtccagtgcagacctggctgggacaagagctcgagaaatgtggcattgatgccatgatttacactcggtatgtcctcagtcttctgctgcatgacagctatgactacgacctgcaggaacaggagaatgacatcttcctgggctgggaaaaaggagcttataagaaatggggaaagagtaagaaaaaatgttcagatctaactctagaagaaatgaaaaaacagaatgctgtccagtgtcttcgatctgcttctgatgaaagctctggtatcgagactttagtggaggagctctgctccagactgaaagaccttcagagtaagcaagaagagaagattcacaaaaagttagaggggtctccctctccagaggcagaagcaggaagcgcttcctgcttctgccaccaggaataagggaaaagacgagcaggaggctctcaagagggatccaagagaagaggctgcttttttgacctctgactcatgtgtctgccgcaggggttttgaacctaaattgccaccgaattatagcaaaccggcagctcaaacatttaagcttcaaaaggagctaaaaacaaaggttctttccttttttgagatggggaaattaaagacaggaaggtcagtgtcgctgtgaatcagggccaagaccagcacaaacccccatttctcagttcctgccgctttcagagaacactgcccttctccaccagcctcttcagc

SEQ ID NO: 385208 - DNA, 2622 bp, Homo sapiens
aattccgctgctgcctgcgtcttttgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggggattataagtcaaggaccaagttcagatacttgagacaaagtggaaagtctcagcatatggaaacaaggccttggaggagaccatggacatcaccaagttcatgtgctgggctggaaagaaaagcctgttgattttcacttgctgtgcatttattcatccattccattgcctcaatgctgagaacagtgcctgacacataaaagatgctcaataaatatgttaaaagta

SEQ ID NO: 385209 - DNA, 4568 bp, Homo sapiens
  misc_feature (3538)..(3538): n is a, c, g, or t
aattccgctgctgcctgcgtcttttgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgttttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagnccaccgtggtgaggagagagtggctccacgaccccaaggtgctgggattacaggcatgagccaccatgcgcggcccacatgcatgttttatgtatgtatacttcatgatgtaaaaatcccacctttatgggccaaagattttttttctcctgaaagcaagaaaaaatgaaaacaaaagacaaaaaaaaaaaaaaagcgtccaggcgcgggggctcatgcgtgtaatcccagcacttggggaggccaaggcgggcggatcacgaggtcaggagatggagaccatcctggctaacacggtgaaaccccgtctctactaaaaattcaaaaaatgagccgggcgtggtaggcgggcgcctgtagtcccagctactcgggaggctgaggcaggagaatgggcgtgaacccgggaggcggagcttgcagtgagccgagatcgctccatgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385210 - DNA, 3747 bp, Homo sapiens
  misc_feature (2676)..(2676): n is a, c, g, or t
gcgctctagaggtccccattgatagcggataggggtgctcatggtgaacagcactattatgcatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgttttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagnccaccgtggtgaggagagagtggctccacgaccccaagggatggccttctcctcccacccggtgaggggaaagactcaccagagggtgatggagacagtatgccggctcaccttggtgaccagccaagatgtctcaagtgacggtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagttgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385211 - DNA, 2272 bp, Homo sapiens
  misc_feature (1201)..(1201): n is a, c, g, or t
atcagctcggtaccgattacgctcctagacggcaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgttttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagnccaccgtggtgaggagagagtggctccacgaccccaagggatggccttctcctcccacccggtgaggggaaagactcaccagagggtgatggagacagtatgccggctcaccttggtgaccagccaagatgtctcaagtgacggtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagttgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385212 - DNA, 1712 bp, Homo sapiens
aattccgctgctgcctgcgtcttttgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagtgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385213 - DNA, 2096 bp, Homo sapiens
  misc_feature (1025)..(1025): n is a, c, g, or t
gctgatgtgttcctggtcatagctatgtcttgtttctgaccttagctcgggatgaaacactgctcttaaaaaaactcagttttccttccagaaaatgtgggtgttttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagnccaccgtggtgaggagagagtggctccacgaccccaagggatggccttctcctcccacccggtgaggggaaagactcaccagagggtgatggagacagtatgccggctcaccttggtgaccagccaagatgtctcaagtgacggtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagttgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385214 - DNA, 1182 bp, Homo sapiens
ctcactgcagcatctgccttgcaggttcaagcgattctcctgtctcagcctcccaagtagctgggattacacgcccaacaccatgccctgctaatttttgtatttttagtagagacggggtttcatcatattggtcaggctggtctcgaactcctgacctcaggtgatccacctgcctcagcctcccaaagtgctgggattacaggcatgagccaccatgcgcggcccacatgcatgttttatgtatgtatacttcatgatgtaaaaatcccacctttatgggccaaagattttttttctcctgaaagcaagaaaaaatgaaaacaaaagacaaaaaaaaaaaaaaagcgtccaggcgcgggggctcatgcgtgtaatcccagcacttggggaggccaaggcgggcggatcacgaggtcaggagatggagaccatcctggctaacacggtgaaaccccgtctctactaaaaattcaaaaaatgagccgggcgtggtaggcgggcgcctgtagtcccagctactcgggaggctgaggcaggagaatgggcgtgaacccgggaggcggagcttgcagtgagccgagatcgctccatgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385215 - DNA, 2416 bp, Homo sapiens
aattccgctgctgcctgcgtcttttgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacgacccctatccgctatccaaatggta

SEQ ID NO: 385216 - DNA, 1416 bp, Homo sapiens
aattccgctgctgcctgcgtcttttgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacgatctgccttgatcagctgtcactgtgcatccccactgagcagtgcttaagaggacttgataaatattcgtggagtgaacgtacttcatcacatttctgtgatgtttaagcttactgaggagcttaaattactctgttttagtagtttttacggaatggcttggtttcgtaattttccactttctttctcagaacatttctcgggttctcagaaacaattatcggaatgtttctcagcatattttctaagttgccctattgtcattaattaataaaaagttactatacgga

SEQ ID NO: 385217 - DNA, 604 bp, Homo sapiens
acacacgccgagcacacctgagaatgggcacgcgttctgcctaacgccccttctgaggcgcacggttggacctggtgactgacagctgtttcttaggtgactgttgccttttcaacgtgcttgatctatcatgaaatataagctgccctgccccacggtactttcagggatccacttttaaatgatttcaaaagccacattctcagtattgctcaggcgctgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385218 - DNA, 602 bp, Homo sapiens
agcgctgtgcaatacgggtgggggtggtggttgtggtaaactttaatatgtgtaggaagcttgaataatttattgaaggagaggggtcagggttgattcgggaggatcctattggtgcgggggctttgtatgattatgggcgttgattagtagtagttactggttgaacattgtttgttggtgtatatattgtaattgagattgctcagcgctagcgctgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385219 - DNA, 649 bp, Homo sapiens
agttcactgcagcctctgctccccaggctcaagtgatcctcccatctcagctccagaataactgggactacaggtgcacaccaccacacccagctaatttttgtattttttgtagagatagggttttgccatgttgcccaggctgatcccaaactcctgggctcaagcaatcctccctccttggcctcctgaagtgctgggaatacagggtgagccactgctcctggtagcttgtcctatttttaatcatgcatttatttgtcttcctcactagacgatctgccttgatcagctgtcactgtgcatccccactgagcagtgcttaagaggacttgataaatattcgtggagtgaacgtacttcatcacatttctgtgatgtttaagcttactgaggagcttaaattactctgttttagtagtttttacggaatggcttggtttcgtaattttccactttctttctcagaacatttctcgggttctcagaaacaattatcggaatgtttctcagcatattttctaagttgccctattgtcattaattaataaaaagttactatacggatcgaatgcctatttacatgggctttacggatatcgtctcttaattcttgcacagtgcatatggggaacatatgacctccatt

SEQ ID NO: 385220 - DNA, 4609 bp, Homo sapiens
  misc_feature (3538)..(3538): n is a, c, g, or t
aattccgctgctgcctgcgtcttttgcgctcggcctcgcccgcggccctccttccccggctcccgctcgccgctcgttcactccaccgccgccgccgccgccgccgctgccgctgccgctgccgcacctccgtagctgactcggtactctctgaagatggcagaagctcaccaagctgtggcctttcagttcacggtcactccggacgggattgacctgcggctgagccatgaagctcttagacaaatctatctctctggacttcattcctggaaaaagaagttcatcagattcaagaacggcatcatcactggcgtgtacccggcaagcccctccagttggcttatcgtggtggtgggcgtgatgacaacgatgtacgccaagatcgacccctcgttaggaataattgcaaaaatcaatcggactctggaaacggccaactgcatgtccagccagacgaagaacgtggtcagcggcgtgctgtttggcaccggcctgtgggtggccctcatcgtcaccatgcgctactccctgaaagtgctgctctcctaccacgggtggatgttcactgagcacggcaagatgagtcgtgccaccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgttttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagnccaccgtggtgaggagagagtggctccacgaccccaagggatggccttctcctcccacccggtgaggggaaagactcaccagagggtgatggagacagtatgccggctcaccttggtgaccagccaagatgtctcaagtgacggtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagttgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385221 - DNA, 4055 bp, Homo sapiens
  misc_feature (2984)..(2984): n is a, c, g, or t
aaacgttaggctagtacgggccgggggtgaatcggccgaggccaagatctggatgggtatggtcaagatcttttcaggccgaaaacccatgttgtacagcttccagacatcgctgcctcgcctgccggtcccggctgtcaaagacactgtgaacaggtatctacagtcggtgaggcctcttatgaaggaagaagacttcaaacggatgacagcacttgctcaagattttgctgtcggtcttggaccaagattacagtggtatttgaagttaaaatcctggtgggctacaaattacgtgagcgactggtgggaggagtacatctacctccgaggacgagggccgctcatggtgaacagcaactattatgccatggatctgctgtatatccttccaactcacattcaggcagcaagagccggcaacgccatccatgccatcctgctttacaggcgcaaactggaccgggaggaaatcaaaccaattcgtcttttgggatccacgattccactctgctccgctcagtgggagcggatgtttaatacttcccggatcccaggagaggagacagacaccatccagcacatgagagacagcaagcacatcgtcgtgtaccatcgaggacgctacttcaaggtctggctctaccatgatgggcggctgctgaagccccgggagatggagcagcagatgcagaggatcctggacaatacctcggagcctcagcccggggaggccaggctggcagccctcaccgcaggagacagagttccctgggccaggtgtcgtcaggcctattttggacgtgggaaaaataagcagtctcttgatgctgtggagaaagcagcgttcttcgtgacgttagatgaaactgaagaaggatacagaagtgaagacccggatacgtcaatggacagctacgccaaatctctactacacggccgatgttacgacaggtggtttgacaagtcgttcacgtttgttgtcttcaaaaacgggaagatgggcctcaacgctgaacactcctgggcagatgcgccgatcgtggcccacctttgggagtacgtcatgtccattgacagcctccagctgggctatgcggaggatgggcactgcaaaggcgacatcaatccgaacattccgtaccccaccaggctgcagtgggacatcccgggggaatgtcaagaggttatagagacctccctgaacaccgcaaatcttctggcaaacgacgtggatttccattccttcccattcgtagcctttggtaaaggaatcatcaagaaatgtcgcacgagcccagacgcctttgtgcagctggccctccagctggcgcactacaaggacatgggcaagttttgcctcacatacgaggcctccatgacccggctcttccgagaggggaggacggagaccgtgcgctcctgcaccactgagtcatgcgacttcgtgcgggccatggtggacccggcccagacggtggaacagaggctgaagttgttcaagttggcgtctgagaagcatcagcatatgtatcgcctcgccatgaccggctctgggatcgatcgtcacctcttctgcctttacgtggtgtctaaatatctcgctgtggagtcccctttccttaaggaagttttatctgagccttggagattatcaacaagccagacccctcagcagcaagtggagctgtttgacttggagaataacccagagtacgtgtccagcggagggggctttggaccggttgctgatgacggctatggtgtgtcgtacatccttgtgggagagaacctcatcaatttccacatttcttccaagttctcttgccctgagacggattctcatcgctttggaaggcacctgaaagaagcaatgactgacatcatcactttgtttggtctcagttctaattccaaaaagtaattccactggagctgctgggaaggaaaacgagctcttctgatgcaaaccaaatgaaaaataggcattaatcctgaccttagctcgggatgaaacactgctcttaaaaaaactcagttttccttccagaaaatgtgggtgttttttttttcctagaacagtatctctcccctgtgaagcataaccccactacttccagacttgccctcccttgggggacatctgataaagtctcccctgatgtctccgcatcggcttggatttattaagggatgcaaatcttgttgagttaatgaaggaattagtagggttgtggcttcacacacagtggaatggaaatggtgtgctttctcagtggcaaccgaaggcctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcctgtgtttgcctctccacatttgaagcaagcaggatgcaaggtcttcagttttactgaccttgtatgtcttcaagtcttcacaacccagtgccttaaaaatgaaaggccctaaatgtaagggagatggagagaaagatttattttgtagagtctttgggtggaattgtgggtatactgttcccttcacaattgactgagtatggataaccgtacataagcatttgctacaccccaccagccccctccccctcagaaacaccagttccttcccaagggcagctgtgccagactcccctcccgggactgccttcttgtcatcataagcaacaaaagaaataacaggcacatgtcataaaaggggagcaagggccgtgatggtcagataattcactcaagaataaaacatgacacgtgcctcaggaggatctctttcccaaagtgacagcaaggagggcagggcatcggccaccaagcggggactagcaagtgaggaaggggagggcagnccaccgtggtgaggagagagtggctccacgaccccaagggatggccttctcctcccacccggtgaggggaaagactcaccagagggtgatggagacagtatgccggctcaccttggtgaccagccaagatgtctcaagtgacggtgctaggtgttcacccagcctgtccttcagataggagtgccttcacgaaagcgtctcatggaccacaaagcaattatgcactgagtcatcttcagtatttaatgcaaaaatgaagcatcatggaatgaaattcccactgtctgtcatgacaagcttagctgtccattgttttaaattgtgtatttatttttttgaccacttggttctagttgggcctgactccttcagagtgctgcaccccgatagtacaacagcgatggctgaactgttggagtcgatggaaggtgcttgccggagaacacgtgcctttttttttttttttttttttgagatggagttgcactccagcctgggcgacagagcgagactccgtctaaaaaaaaaagcaaaaacaaaccaacaacaaaagcccctgactgtccgtcaagcaggcagcggggatgtagctctctctgccctgggcaagaatagcacttcccgttaaaagccagcagccggcgtcagtccctatcagagccagctagatcatgcactgttgaccactgagcaatctgtgttacactagagttcacagggcattttgagtgtagacgtgagtgcttaaacatatttgggtttctctctcaggttttaaatgtttcaaatgtaattgttgctcatcagtgcagttatcaatgcaattttatattccttgaggggagaaagaggggtcttattgtacatgtccaaggggggtgataagagtattatctgtttaatttaattggaacaaaccattgtcttaacgcagccatggtttgaatttgttatcttgggctgaccggtgcatgtaaatacagtatgctctttggatgtaaatcttagaaatgcagtgtgaatgtaggttatcattaataaaacattaaccccagtctactaaaaaaaaag

SEQ ID NO: 385222 - DNA, 2845 bp, Homo sapiens
gggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385223 - DNA, 384 bp, Homo sapiens
caccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaaga

SEQ ID NO: 385224 - DNA, 2682 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385225 - DNA, 1641 bp, Homo sapiens
gcttgggcctagctaccatctccctctaatcccaggttctctacactgccctggggttataccagtctggattggcttctggttgagaaatcaaagctgggcgtatgattgacttaacccttcaggtattgttacttgaataagtcaagtgcctgagctctcacccacctatgatctgtcctttcccagacctcgctggtagtccgtggtcaaggagatctaggatctagtcgcattacgctgctgtgcggacgaagcgtgtcccacgtgtgccaggccccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385226 - DNA, 2421 bp, Homo sapiens
  misc_feature (2399)..(2399): n is a, c, g, or t
  misc_feature (2401)..(2401): n is a, c, g, or t
  misc_feature (2413)..(2413): n is a, c, g, or t
  misc_feature (2415)..(2415): n is a, c, g, or t
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggcgcggtgggaangngtgttaaaggtnancggggg

SEQ ID NO: 385227 - DNA, 2455 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctcacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385228 - DNA, 2123 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtggcgaggaggcgtctgaggcagggcttagagcggagcgcggcttgcagaagagcgagggctcagacctttcaggagaggaacgctctcggccggcgccgcagtagtgcctgaggaggagctcagggccttagcgtaggggcggcccacattggcagccagcccctccccgccatgctcccggcttggctgtgtttggccagggctgggccgtgtcataaagagttttgcagtgtatc

SEQ ID NO: 385229 - DNA, 1777 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385230 - DNA, 1671 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgg

SEQ ID NO: 385231 - DNA, 1463 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccg

SEQ ID NO: 385232 - DNA, 2596 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385233 - DNA, 2452 bp, Homo sapiens
gggcgtgcggtgtccgcggcggcgcagggagggggagggaggtaaacaagatggcggcggcgtgtcgggcgcggaagggggaggcggcccggggcgcccgcgagtgaggcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385234 - DNA, 2655 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgg

SEQ ID NO: 385235 - DNA, 2422 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385236 - DNA, 2129 bp, Homo sapiens
ggcaacagcaaagcatcacgctgagcgccgggaccttctgagtgcaggcggtgggcgaagccccgagtcacacacacccacgacgccggccctgctcccacagcggccctctggggtagcgactggtattacctgcatttcacgagggaggaaactgaggcacgaactgttcagaagctgccctgaggtcaccaagtgagctaggaagaggcgtgggctcgatctctgccacatccacctcgggaaaccacaaggtcctcctaaatgtcttcccagccccttcgagagaattgtggaagtggggttgccagatcaaacacaagacacccagttaaaattcaactgtaggcaaggattcagggacatctcagagccgctggggtctcgtcggtaaagtggtggtggacggcatggaggaactttagccctggaccagaaactttaggtcagtctatgtcagccattgttgctatcagccttcaggtcgtctgggctgggaggtctcctccctcttcctccaggcaccagtgggagcaggcagtcacaccttcctgtgagtgagaaccatagcagaaccttcaaagcacctctcaagtcggggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385237 - DNA, 2508 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgg

SEQ ID NO: 385238 - DNA, 1731 bp, Homo sapiens
aatttttgtatgtttagtagagacgggggtttcaccatgttggtcaggctggtctcaaactcctaacctcatgatctgcccacctcggcctcccaaagtgctgggattacaagcgtgagccaccgcgaccggcccaaggtgcttttttaaagctagtgacttcctgtgcacatggggtgggtgtgtggcaagttctggaagctgctgagtcagccactggtccattctcggagctggggctctgcactgggcacatgagctctggggcagcccggggcggcctcccactgacttcgcccgggaggggcctcggggatggctcggcagccagtgtgttcgcggagtcctcgccaaccaccacggctcctcgcagggacagtacgtgggcagcttcctgcactttcccctgccattgtgagaacagtgtccacctgggcagggtgggcagccccaggcctgtgggtttcaccagggtgctggtgatggttggtggctagcagggactgggggcagctgggggccctggcaggctgagctctgctccccgcgtggttctgtgctggcatttcgagtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcatttcaggctggatacacctgggcctgacccgggggcgggcatggcctgggcagcagctgtaagtgcgtccccgtggtgggggccagccaggtccctgtggctctggggttgcgcccctcagctcaggccacacttgccgtctccctcccaggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385239 - DNA, 1697 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtgcgtgcgcggggcaggcgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 385240 - DNA, 1164 bp, Homo sapiens
ggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctttctctttctttcgaaagaaagag

SEQ ID NO: 385241 - DNA, 588 bp, Homo sapiens
tccagggtgggagctgagcacccctcccttcaggtgaagctgctggagctgcaagagttggtgttgccccttgtgggcaaccatgaggggcatggcaaattcctcatcgctgcccagaaccctgctgatgagcccactccaggggccccagccccccaggaacttggggctgccggtgagcaggatgttttttatgaagtgagcctggacaacaacgtggagcctgcaccaggagcggccagggagggttctccccatgacaaccccactgtacagcagatcgtgcagctgtctcctgtcatgcaggacacctaggagcacccaggcttgcccagcaaaccctgcgtgccattcttctaccaggcagccgagaacagggagataaacatcatcatcttctaagagctggtcaagaaatttaaaacaacaacaacaacaaaaagttacggggttcatctcctacacaattcatttactccatttgaatgctagagccactcacatttatttgtgtttctaatttaccgtttaaatttatttgtaaaaagttaagggagagttggtctttccctgatgttctttctggca

SEQ ID NO: 385242 - DNA, 1151 bp, Homo sapiens
acactcttaatttctaaggaagtgtagcgttcccttgatgaatcaggagagagatcattgaacttggtgtatgaggtactctggtctgtcttttcaagcttggggtaagtaggcatctgcaactaccagtcatatattttgtaacccactggcccgtgtgtgccctgattgctgaggctagacagatccatcagggcttagacagttagtgagggtcctgggagtaggcgaagggaagtccagttaatgtgtgaagctgctgggaattgtgtagttggcagagatttgagcaggtaaagcttccgatgtggaccaagtacaagtactaagatcacggcacatcctctaaaaggaagtcagatatttgggactgtccaggaaatctgggagatagtgtgatggtggcatagctctttctcatctgacactttttatgcttactcagagtacgaatgccaagtattgagacgatacagaataatatttgaattgagatattcctagaaagacaggtcaacatggctcttggtcaagaatgacttagagttccttgcctagtgctcagctggcttcatgtcatagttgaggctgggtccacaggtgggataagattccaccaaagctcaccaggctggtactgaccccagagtgtctcccaggccctaccttattttagcattcttttgaattgagtttcagaggtgattcagtagtaaatgtatggggagaagaattagaaaaacccatctctttttaagcagtcatcattcttaaacatctgaattgttttacaacagagtcagcaaacctttctagcatttctaaaagatggcagtttcttggagaccacatctttgcaaggcagtattttcaaaatataaaatagcccccaaaccaaacctttaaacatgaagggcaaatgggtaaagacttaatattctttttgtgtcaagtatacttaatgtaaatctagttgcttgtgaagtagtaatagtaatagctcctattattttgagcactgactatatgtgctcagcctctgtgcttgggatctgacatcactatctcatttccttctctcagcagttctggaaggagtacctaccctgggtatgctttgcccagggtcacagaagttactgaattagagc

SEQ ID NO: 385243 - DNA, 545 bp, Homo sapiens
tggccttttgaaactttaaattacaattgtgattctcccgtgtccacatggctggggaggcctcagaatcatggcaggaggcaaaaggcatttcttacttggtggcggcaagagaaaaatgaggtagaagcaaaagtggaaacccctgataaacccatctcagatctcgtgagacttactatcatgagaataacatgggaaagattggtccccatgattcagttacctccccccgggtcccacctacaacatgtgggaatcctgggagatagaattcaagttgagatttgggtgaggacgcagcgaaaccatgtcagagggtaagaggtcccagtggcagagtaaaagcatcattcagacaaatagaaggagactcaggaggtacgagagagaggaataaaacctctttggattatacattgtgaaggagttgcagtggaggggcggagggctgaaggaaaggttttgaagagagagggaatctatgggtggtgagcagtaaagccattaggtgttggtgacccttggcactgctcaccctcctt

SEQ ID NO: 385244 - DNA, 833 bp, Homo sapiens
agacctttacttttaatttcaggatctggagagcagaaactttcgtagttcaaaaaaattcctcatgcttagtagcttcctttcctaaaaatgcaggtgggctttacagcttcccatcagacttatttatttgtctttcttctcaatgtgttttgtatttgtatccagctgtgggagaaagctttctgagaaactccatgtaccttttttattagttgaaaataagaatgttcaaacattacctcaggtgggaatttgactttgcttctgcatttttcattttagcttagtatttcaattttaaaatagattaaggtatgtttagtatttttatagaaaagtgctgcctaatccttttgaggacacagaacggtaaattccctaattagtgcagtcagaactgaagagttcttcctgaaaagctgtattcacacaggagtttacatttttgtcagttaaattttcagattttctttcatgcagaaatttgccacagcatgatacataagaaaaaacattcaagatgatgtcacaaggcctatattttatagccccacctgcacttcaaaggcattgtgcaagagttaaaaggtttgcccaatctaaggtatttctatgtatagaaattatgtattattagatatacagagaatgtgattcattttctcattattcaatatatttagtagctcattgaagatccctgggctatgtccttgttgttgttgttgttgttcagggctcttctatatatacaatgacaaaacaataaaacctaaactttttagcctggataaaatctacccaaccaacatgaagtgcaggaaacaaga

SEQ ID NO: 385245 - DNA, 2146 bp, Homo sapiens
  misc_feature (46)..(46): n is a, c, g, or t
cggacgcgtgggctagttctagatcgcgagcggccgctcgcgatcngcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaatctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctgaatggacatttgtggctgactttcatgggctggtccaatggctggttgtgtgagagggcttggctgatactcctatgcttgagttcaaaggctgaaaattcagttaaggtgttacttaataatagtttttaggctccatgaattggctcctgtaaatactaacgacatgaaaatgcaagtgtcaatggagtagtttattaccttctattggcatcaagttttcctctaaattaatgtatggtatttgctctgtgattgttcatttttttctgctacttttgggtagaaaaaagattcaattgcttggctgtagctttctctcatatatatcaccctaaatataatgaagatcttttagtgtgtatcattttccttttagaaactagtattctcttatttcttactttaatgtacttctatcactgcatttattttgcctgtgcataggagcaattaggatctaaaaaaatatatgggaagataaaagatctaagaacaagtacttgctggaaaattagttggctggacattgataaaataatgcatttataacaattacatgtgtttctgggaacaaggaaaatttctcaaaaaagaatatttcacacatcccttcttttgaatggcctctttgtgaccagccagacctcaggtcttcactctttcttctttgtaaactatgtcatgtggaaagatttcctcagttagtgagcttgtgtctgcaaattgattttgtttgtaatgtattttgatagcaaatcatgctgcatctatatctttttcttgtttgagctgttactacattgtacatggcatgtgggatcaattaaaaatttgttttaaaaata

SEQ ID NO: 385246 - DNA, 2642 bp, Homo sapiens
ggccggtggcccgggcccgaccaccccagctgcgcgtcgttactggccacaagtttgctctgggccagccaagttggcaacttggaagcttctcccgggctctggaggagggtccctgcttcttcctacagccgttccgggcatggccgggctgggggcgtcgctccacgtctggggttggctaatgctcggcagctgcctcctggccagagcccagctggattctgatggcaccattactatagaggagcagattgtccttgtgctgaaagcgaaagtacaatgtgaactcaacatcacagctcaactccaggagggagaaggtaattgtttccctgaatgggatggactcatttgttggcccagaggaacagtggggaaaatatcggctgttccatgccctccttatatttatgacttcaaccataaaggagttgctttccgacactgtaaccccaatggaacatgggattttatgcacagcttaaataaaacatgggccaattattcagactgccttcgctttctgcagccagatatcagcataggaaagcaagaattctttgaacgcctctatgtaatgtataccgttggctactccatctcttttggttccttggctgtggctattctcatcattggttacttcagacgattgcattgcactaggaactatatccacatgcacttatttgtgtctttcatgctgagagctacaagcatctttgtcaaagacagagtagtccatgctcacataggagtaaaggagctggagtccctaataatgcaggatgacccacaaaattccattgaggcaacttctgtggacaaatcacaatatatcgggtgcaagattgctgttgtgatgtttatttacttcctggctacaaattattattggatcctggtggaaggtctctacctgcataatctcatctttgtggctttcttttcggacaccaaatacctgtggggcttcatcttgataggctgggggtttccagcagcatttgttgcagcatgggctgtggcacgagcaactctggctgatgcgaggtgctgggaacttagtgctggagacatcaagtggatttatcaagcaccgatcttagcagctattgggctgaattttattctgtttctgaatacggttagagttctagctaccaaaatctgggagaccaatgcagttgggcatgacacaaggaagcaatacaggaaactggccaaatcgacactggtcctggtcctagtctttggagtgcattacatcgtgttcgtatgcctgcctcactccttcactgggctcgggtgggagatccgcatgcactgtgagctcttcttcaactcctttcagggtttctttgtgtctatcatctactgctactgcaatggagaggttcaggcagaggtgaagaagatgtggagtcggtggaatctctccgtggactggaaaaggacaccgccatgtggcagccgcagatgcggctcagtgctcaccaccgtgacgcacagcaccagcagccagtcacaggtggcggccagcacacgcatggtgcttatctctggcaaagctgccaagatcgccagcagacagcctgacagccacatcactttacctggctatgtctggagtaactcagagcaggactgcctgccacactctttccacgaggagaccaaggaagatagtgggaggcagggagatgatattctaatggagaagccttccaggcctatggaatctaacccagacactgaaggatgccaaggagaaactgaggatgttctctgaatggacatttgtggctgactttcatgggctggtccaatggctggttgtgtgagagggcttggctgatactcctatgcttgagttcaaaggctgaaaattcagttaaggtgttacttaataatagtttttaggctccatgaattggctcctgtaaatactaacgacatgaaaatgcaagtgtcaatggagtagtttattaccttctattggcatcaagttttcctctaaattaatgtatggtatttgctctgtgattgttcatttttttctgctacttttgggtagaaaaaagattcaattgcttggctgtagctttctctcatatatatcaccctaaatataatgaagatcttttagtgtgtatcattttccttttagaaactagtattctcttatttcttactttaatgtacttctatcactgcatttattttgcctgtgcataggagcaattaggatctaaaaaaatatatgggaagataaaagatctaagaacaagtacttgctggaaaattagttggctggacattgataaaataatgcatttataacaattacatgtgtttctgggaacaaggaaaatttctcaaaaaagaatatttcacacatcccttcttttgaatggcctctttgtgaccagccagacctcaggtcttcactctttcttctttgtaaactatgtcatgtggaaagatttcctcagttagtgagcttgtgtctgcaaattgattttgtttgtaatgtattttgatagcaaatcatgctgcatctatatctttttcttgtttgagctgttactacattgtacatggcatgtgggatcaattaaaaatttgttttaaaaata

SEQ ID NO: 385247 - DNA, 754 bp, Homo sapiens
aaatgaggacctacagggcagaaaggtcgcctccgtccccagcacctgcaggttcccttccacacttcgtggtcctcagcagcatcttctaaatcacattccttctgattttgaaccctgatgaaaacttctagtgacatccaccacccccactgccgcctccgggatgagtccagcccctcaccctgtcctggctgccttgggctgggctggcttctgtccagctccacaccctcaccttggggggccttgctgtctcccggcctcactcttgcccctgctgcccctccctcggccgttcaggctcctcgctgtgcacgtgttcatttactcacaaatgttcacagaacatctggtcacggcactggcccactgctgggggatgctgggccaccagtccctgctcttgtggtgctcagagcctggggagggagacggagacaagccccggtaagtcctgagataaagcgtccagtgggggttgacaggatgccactctggaagccccgtctggcacgtttatttctgggctccctccatgacccccttccttgcttttttctatcacatggggtcagccccactttgtctgcttccctcttctgctctgctctcctgagcacgggactcatgtctggttgtaatctttacagcctccagggcaggtacagagcaccttgctgccttgcttgtttgttgactgagggagggagggactgatgagggagggagggaatgagtgagtgactgagtg

SEQ ID NO: 385248 - DNA, 480 bp, Homo sapiens
actacaacctctgcctctggggttcaagtgattcttatgcctcagcctcccaagtagctaggactccaggcatgtgccaccacgcctagctaatttttgtatttttagtagagacagggtttcaccatgttgcccaggctgttcttgaactcctggcttcaagtgatctgcccacctcagcctcccagagtgctgggattacaggcgtgagccactgtccccagccaaagaactgtgtctttaataagttgttgttctgccctgcagtgacacagctgttcttgcagagtccttttgtggaaactgcagtagggccaatggcagggctgggataggaggaaggagagtggacagacatgtggggcctgtggcagaggtttatggagcctccttctttcaactgcgttctcaccactccaggaaagcaactgtgcttgtctgcttgttttgattcttggttatgcttgatgagattcattt

SEQ ID NO: 385249 - DNA, 198 bp, Homo sapiens
tggctaagtttttataggggctggaaagtttataattaaggtgacatcatgtcatttattgtccaaactaggatgtctttgcctatgaaatgtctccttctccatatccccctcctcaaagacttactgtttcatatcaggaaagggtactcttacaggcaaaaatctgtatttacttgtttcggagtgttatcctcc

SEQ ID NO: 385250 - DNA, 435 bp, Homo sapiens
taaatccctatcttttttcagccacagcctgctgaaggtacttctcaactgataccatgaataagactcagtctctgacttcagaaacttgcaaccaacagtggggttcagaggtacccagtgacacccagggtgatgtgctggccaggaactcagcaaggtcaagtgtcttgcccagcatgggacttggtgggcagaaggagagggctgatatctccccaaggaaggattgggtcattagcttggcctttcacactcccaaattgttgggttaggcaaggactggcagtgtgaggggtcagaccacagcaatttctcctccttctgaagtgaaccagtgggggaaatgtcatgtatgctcatgaggtgtcactggtcaataggcaagcattgactcagcactgtctccgtgcctagcattgtgctaggtgctat

SEQ ID NO: 385251 - DNA, 610 bp, Homo sapiens
aagagtggaaacttctgaagaaaatagccatgttaccaatgtcgtcacgctgaagccacagagtcaagttagtggcaatggccgtggactgggagccaattgaactgggtttcaatcctgcctttttttttattatttttaaatgcaactgtatgcaaattgcttcttctccctgagtctccattttctcatttataatttggggagcggggtagagagtctttacttaaacatagggcattacccctccatacatccatatttatgtgccctcttaagatccttctaagatatttttaaaaacaaaggctaagctctttaaccataagaacccactgtggatgcaggacatcaatacatttccaggggggaagacattgggtcattgggtaggtgctgactgatcaaacaaggtggaggaagccacaggagacagtaacaaagaaataaatacagccatgcaccttactgaatcttggagagacttgggattctggaacaccagttataattaagcatcggagcaagccacagattgattctggactggcatgattttgccccaccctcaggggacatttgtcaatgtttggagacatcttgagtatca

SEQ ID NO: 385252 - DNA, 591 bp, Homo sapiens
aaggaaaaaatagcagaggtaaaagggagggtatcttagacaaggggagcaatgctggaaggagggaaggctctgatagtagagaagacgttggcctctgtctgagcagtgagagctgccagtttgcagcagagatcaatagaaaatagcaacagttaggcaagataaagcccaaatttggagagctttgacatctgggcatctaggtagaggaggtaaatttgcccagctggaaaatggaaacctatggacttcctgagcacctgggagtaactaagatgttcatatgatttcaaatccagccatcctcagaacccagtttgttctcccattatccatgtttatcctcccagccaaacttttaatcagtgcagatgaagttctagattttagtcccacaagctcaataatttgagattcttcaaatgttgaggatgaggccaatagtggaatggaaagccacctctctcttctttgtgaatgaccaacctttggttcacaccatggatacacttatacatacagtcattatctttggaaaatgaatgttcttttctattgattgaatcttacagtgaagtaatggacaga

SEQ ID NO: 385253 - DNA, 561 bp, Homo sapiens
caggaagactgagggggactgaacatgattacttgtctgcctagagcttcttgtaaagaagtcacaaacttagtgcctccaggggcttggcctgtgtgataatgaggatagaggattacttgtgaggcaatgtggcatggtggggattgtggcaaactagaattcacatcacccaccatatagggcttgcattaccacgaggcagaaagcacctagtgttgctgcatcttcttacgcaaaaaagacaaaatccagacttctaaaatgtaaaatcactgattttcgatattggcagcttactttttttttttaaacaaccatgcaggccaaatgacttgtaatcttgtcaccatttttaggtaaactgtgacttgaaaaagtctggagcaaacaaaccaatgctttttccttttattctgttggaaaccagttttctttgtgtcacagttctgaaacctcaatacgaatatttctcttcccaccaaatattttgaggcaattgaaaagccacagtgatttatttcttgatttggcaattttaattttgcaagacactgctta

SEQ ID NO: 385254 - DNA, 259 bp, Homo sapiens
acagatataagacagtactagctggtagtatttttccctaagaattaaatgttgtttgtttcataaacctataatatttttatagtttggcagcagtgactttggaatgaaagccaacttcagatgccaactctaccattttgaaaccgtggagacttgtgctaattgtttaatttttgagctttgtttatttgtaaaatgtgtggaacagtacttacctcaaaggctgttgagattattaaactgcttatgagaaagc

SEQ ID NO: 385255 - DNA, 439 bp, Homo sapiens
ggagatgaaaccacatctctgtgggattgaaaaggtcaattgaaactagcagccacttttcttcatgaagttccagcagcacattctgtctgctgatatttggggagacgaacaactcaaagagaaggggtcattttaaaatagaatggcctctctgtacttgactccttctcatcagtagcctctaaatggcctcttgccaaaaccaaccaagtgtggcttctgtacttcaaagccatctgcagtgacacagcagccttcagggaaggtcactgggtggacagttctccatgcagccttagtagggcccagagtactgcttcatccctccctaaaccatagtatacaacccgcagaggcaaggtgagtccgcttccatgctaccccatattagagggagggaaacaaaggctggtatctcatggtaaactccagacct

SEQ ID NO: 385256 - DNA, 378 bp, Homo sapiens
tcatacataccttggtgacttgtgtgtctagaggtaaggtctgagcttcctcctcaaggaacttaagatgtacacctgagaaacaggaggactcctccccccagacctgagccctgagactcttcccttggggcatggataaaggatccctgtggaacagggtcctgagtctacctccaagggtttgaatcataactcaggtgtgtgaaggcctgttccccaccttaggacctgatttctgaacctgccctgagggtactgtcacctcacctcagacaacttacatacaccctagtcttaggggtcatttagggacataagacttcctgcctcggggacttgggccttagactcccaactccttttggggacatgaat

SEQ ID NO: 385257 - DNA, 480 bp, Homo sapiens
tcaaaaaatgtccagaagccatataattgggtggcccagagcaggttagggaggtaactaaagtcattaaagtggattttgaggtttctggttaggtacactgaaggcacaggattgaaaataattcatctggggttacttttaatagctttgcttactgttgctatgatataagacatactgattgtaaaaatttcaagtgaagaagaaaaatatgaaaaaggaactaataaaattgcctgaaatgttaaaaatccagcgataacatttgggtgactatgcttccagattatttaattggcttttctcactgaacagtttgtccagcacactttattcaggtcaataaatgtggatgaccgggcgtggtagctcaaagctataatcccaagcactttgggaggctaaggcgaaaggatcacttaaggccaagagtttcagaccagcctgggcaacatagtgagaccctgtctctaccaa

SEQ ID NO: 385258 - DNA, 443 bp, Homo sapiens
cccctggtttaaacatttttttcatatcacagctcaagttacctcttgttggcattggtcagaacaagtcattcgccctttctttacggttggagtatggcagccatagctccagactgtatgtgtttacatccacagctaggagggacagttccagtatgtctgtcttttttttgtacgaagagtaaaagtttttccagaagctcccagctcgtatctgtttacgttctgttggcctgaattatgtaagacaggcagagaaaacaagtagccttcataatgaaggtgggtaaaggagaagggcctaggaatggctggaagtaagctggccagcaatcagacacagaatttctgctggtacaggcatgtttccatatagcatattgccaagcaagtctgcacctatcccaatcaactttttaacccattttttaaatagtgtg

SEQ ID NO: 385259 - DNA, 312 bp, Homo sapiens
caattaacagctgcagacctcaactaaacactgtggggaaggggaacctaccagcagcccagcctcttgtctctgtttgaagtgaaagtcgtatttggtctcctgctcaactgtgagataaataaccctgttcctcacactccactagaccatatgtctttctctctcttcccctccctaccagtcaatctgtggctttccaattctacaaagaattacaataaaaggcacagatgaagtaaaattttagatgagagtaaaaagacaggggcaaggagaaaagagaaaggagagaagagtggtctatctgaa

SEQ ID NO: 385260 - DNA, 153 bp, Homo sapiens
gtgatcctcccacttcagcctcctgagtagctggtactataggcgtgtgccaccgtgcctggctaattgttgcatttttctttctttctttcttttttattgagatggaatttagctctcgttgcccaggctagagtgcaatggcgtgatctc

SEQ ID NO: 385261 - DNA, 361 bp, Homo sapiens
gcgggtattcttacattataataaacttcatatgttatcaaggtagtctttattataattaggctgatttcatatttgagtttgtgtgctatatgtaaccagagtattatagctcaaataagagagcttggggagaagcaaatggctgacaccaaaagcatgagcaacaaaagcaaaagtagataagttggacttcatcaaaatttagaactttcgtgcattaaaggatattatcaagacagtgaaagacagcctacagaatggggggaagaaaaatattgcaaatcctttatctgataagcactttagaatccagaatctacaaagcactcttaaaactgcccaacaggccgggtgtgat

SEQ ID NO: 385262 - DNA, 1366 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacatgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 385263 - DNA, 2052 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385264 - DNA, 1880 bp, Homo sapiens
aaagtcatttaagcccctttacagaccagctctgctgggaggatgcagaaataaatgatcagcgtcccggcgtgagagagctgcccccagaagtggccgggggagaaaagggtgaagaggagctaaagcttaggaggcgatttccacggaaatggatgctccctaaggatgtgcggaaaggggatgggaatgtgcggattgggggcgggggcaccaacgcactccggcgggcaagcggtctcccgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385265 - DNA, 2086 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385266 - DNA, 2205 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385267 - DNA, 2239 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385268 - DNA, 2304 bp, Homo sapiens
  misc_feature (2304)..(2304): n is a, c, g, or t
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttaaaaaaaaaaaaaaaaaaaaaaaaagaaaaaaagtttgttggggcggcttcgggccttgggaaaagagtttttaaaaaaccacttgtgtgttggggggcgggggcccccatgttgtgtttaatgtgagacgacccgtgtcgggcaaaaaaccgggggtgccccccaaaaagaagagacatcccccggtgcggccaagacgcacacaacgagggcggctgggggagtttttctccccacaaaataataaaaaaaaaaggcgcgcgggggagggacacacgccggaggtgtgtcttggagacacaaactccaagaaggggaggtgcgagaagggcccacagggggttcaacaaccagaggagctacaaaaggcagaggcgagataaaaatacgcgaccacggggggggaggggtgn

SEQ ID NO: 385269 - DNA, 920 bp, Homo sapiens
  misc_feature (39)..(39): n is a, c, g, or t
gtatgcggcactgactctcttaatctaccaccgctacangctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacatgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 385270 - DNA, 1094 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385271 - DNA, 805 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccacatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385272 - DNA, 2204 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtaaaaataccagttgatgtctgttaattttaaaaaaatgttttcattggtgtttgtttgcgtatccagaaagcagttcatgttatccataaatctggttttgtctttttttgttttaaagaaaaagatgtatacatacagtatagctgcattag

SEQ ID NO: 385273 - DNA, 1535 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgattctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgta

SEQ ID NO: 385274 - DNA, 1519 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacatgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 385275 - DNA, 419 bp, Homo sapiens
gtcatgagaaaattcacaaatgtaggaaaagctggtgggaatctttgcaaatatttatgggatgagaaaaaactgttcatattgaaagctggattaagagattcagattcaggccatccctgatatcaaatctaaagtgggcctccatgccagccccttgggtcttgatctcagcaccctgttttacctggacagcagtggccacagtgggtcatttcattcattagttttgatggcatttgtctctctcattggactgtaagttccttgaatcattcttaagttcctaagaatcatgtctgggctgggcacagtggctcacacttatactcccagcactttgggaggctgatatgggcagattgcttgagcccaggagttcaagaccagcctggacaacacggcaaaaccccatctct

SEQ ID NO: 385276 - DNA, 405 bp, Homo sapiens
tattccatcccattttaattagtgagaaaaaataattaaaaagcacaatttccttagctttagttttgattatgaaataataggaatagtatagtattttgtttgaattcaagtctaagaggcagaatttgattaaacctgaagatcttctaaaaacctagttcagagtagatggcttgatatgcattaaaggatttttatatttcacacacacacgtgcacacacaatgtatttttcaacatttcagaacaaaatttgtatcattactaacaaaacatcctacatcaataatggaaaaccaatttgctcaattacatgggactttcaacaacctgatttcatggtagggatagaagaaataattataaaagccattgagtcccaaataaacaccatgccatttt

SEQ ID NO: 385277 - DNA, 596 bp, Homo sapiens
acaggagtttggaataagttgattccaaccctcatggatgactttgaggagttcgactttagtagaggaagtaattccagatgtggtggaaatagagaactagaattagaaacaaagcctgatgatgtgactaaattgttgcaatctcatgataaaactttaatgaggtcaggcacagtggctcatgcctgtaatcccaacattttgggaggccagggcgggtagatcacttgaggtcaggagtttgagaccagcctggccaacatggtcaaaccccatctctactaaaattactaaaattagccaggtgtggtggcgtgtgcctgtggtcccagctactcaggaggctgagaatcgtttgaacccgggaggtggaggctgcagttagccaagatggcagcatacccaggcaggatgtatacccagaaatgacctgagaagacttttagccttcaccccatgttgttcccaaggctcaagacacaccctgctaattagtgaaggtcttccttaccagtttgcaaagacttggggagttggctgtctttccaaatggtagttttcaagaaaagaccacaagacattagaaaaaaaaa

SEQ ID NO: 385278 - DNA, 433 bp, Homo sapiens
gttatcctttgtttttaaggctgggtgcagtggctcacacctgtaatcccagtgctttgggaggctgaggcaggtggattacttgagcccaggaattcgagaccagcctaggcaatatagggaaaacctgtctctactaaaaaattgcaaaaaattagctggatgtggcagtacatgcctatggtcccagctacttggggggctgaagtgggagaatcaactgagcttgggaagttgaggctacaatgagccaagatcacgctcctgcactccagcctgggtggcagagtgagaccctgtctcaaaaaaaaaaaaaagttttaaaggacatatttttaaattgatggcctgaaaatgttataacaaaattctaataataaagaggaaagaataccctaatcctgccagcataacagatggtctatttgacttt

SEQ ID NO: 385279 - DNA, 605 bp, Homo sapiens
tgggagactcctttctcttaggtccagcaggaagttggcggggcccaagcactgtaaggcacagcatttgaggagctgagaagaggggtgagaatttagctggaaaggagttgctgcaaggccattcccggcagggcacagcacccatctaccaacgaagctgttgcagccaaggctcctgcccgtggggccagggggattattcctgggcctctggaggctgggtgggtggtcacagggctgtgctgcagagacacctgttggcctctgggttggctcctgcccacacaggctactgacccactctttgttttctgatttgctttcacgccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccaggg

SEQ ID NO: 385280 - DNA, 1721 bp, Homo sapiens
gggggagtgcgaatttcttggcctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacttgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataataaatgcttcagtgaaaatgcagctttactaa

SEQ ID NO: 385281 - DNA, 1158 bp, Homo sapiens
gggggagtgcgaatttcttggcctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacttgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataataaatgcttcagtgaaaatgcagctttactaa

SEQ ID NO: 385282 - DNA, 1605 bp, Homo sapiens
tgaatgcacgtgtcacaggcgggaggaaaaaggacaactgggctcagaaaaaggggctgccacgccccggcccctgcaagggctcagccccaggaggcagggcagcattgttagttgccaaggagcggagtagggctgtccctcgggtcgccgcgcgccctggcaccccggctcccctgcgcgccctcgcggagcagtaacgcgctttgctttctgtgttgcagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacatgtggttacacagtgtgaataaagtgctgcggagcaagaggaggccgttgattcacttcacgctttcagcgaatgacaaaatcatctttgtgaaggcctcgcaggaagacccaacacttgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataataaatgcttcagtgaaaatgcagctttactaa

SEQ ID NO: 385283 - DNA, 349 bp, Homo sapiens
gtgtaaagcttcaaccatagagaagaaaacatctcagaatatatcttcagttgagtatgaaaattcatcattccataatgtgttttttataccttggagaggactttatggttaaaaactccttttataattcttgatattttaatttaaaagctctttatagtctttaatacttctttagaaatcatgaataccaattcttctagtgatatgttaccttaactgaccaccccaaaccaagagaagttgaatttcatcttaactctgaggatgacagattttgaaaaccttaaaacttcttgagcagtttggatctaatatgtggaccccttaaatggaaaatgctgtg

SEQ ID NO: 385284 - DNA, 298 bp, Homo sapiens
tcagactaagctgttatgactatgctaccaaggaataagcctggtgaagaaacaggcttttctgttaggcacagggctttcggagctgaacaatttcccagtctgatggaagagactgacaactacagtatggagtagtggccatgtacctacattaagagttatttacgatgagtaaataaagggagcaacaggggaccagaggaggtgaaatgaataattttcaccttgccgtattgacttcaagggcctggagaagcgtctaacctagacttctggagtaagctgaagcccaaag

SEQ ID NO: 385285 - DNA, 359 bp, Homo sapiens
cttgatctcctgacattgtgatctgcccgcctcggcctcccaaagtgctgggattacaggtgtaagccactgcacccggccaggcctgagctttttatatacaccaactgccaaacattccacgtgaatttcctgaaacttctctttggaaagcttctgtttgtatgtataaggcaatgtgcatgccagcatgtcagttacagcaggagagagggaacaagccatgtgggaactgatggagccatgtcacatccagtgtcctctgcagccgctatggagtgccaggaggaatgaggggcaaatggcacttgaaaaatggcacaggcaagagcatcatcggatctctccttttcttcctg

SEQ ID NO: 385286 - DNA, 90 bp, Homo sapiens
tgatcacaccaaggctcagtgccatttaatatgctattttgccattttagtttcctcttccacgaatttccatcattgttcattttcctc

SEQ ID NO: 385287 - DNA, 1957 bp, Homo sapiens
tgcgcctgcgccttgtgctcctgactggctgcgctccctgcccccaacaccgccgtggcctgggaaacggtcccagagctgctgagccgacctactggtgtcatggcagccccaaagacagcagctgtggggccgttggtgggagcggtggtccaggcaccaactccactcgctttctggttttcaattcaaaaacagcggaactacttagtcatcacaaagtggaattaacacaagagttcccaaaagaaggatgggtggaacaagaccctaaagaaattcttcagtctgtctacgagtgtatagcgagaacgtgtgagaaacttgacgaactgaatattgatatatccaacataaaagctgttggtgtcagcaatcagagggaaaccactgtaatctgggacaagttaacaggagagcctctctacaatgctgtggtgtggcttgatctaagaacccagactactgttgaggatcttagtaaaaaaattccaggaaatagtaacttcgtcaagtctaagacaggccttccactcagcacttacttcagtgcagtaaaacttcgttggatgcttgacaatgtgagaaacgtccaaaaggctgttgaagaaggtagagctctttttggtaccattgattcatggcttatctggagtttgacaggaggagttaatggaggcgtgcattgtacagatgtaacaaatgcaagtaggacaatgctttttaatatccattctttggaatgggataaagagctctgtgacttttttgaaattccaatggaccttcttccaaatgtcttcagttcttctgagatctatggcctaattaaaactggagccctggaaggtgtgccaatatctgggtgttgggggaccaatgtgctgcattagtaggacaaatgtgcttccaggagggacaagccaaaaacacctatggaacaggttgcttcttactgtgtaatacgggtcgtaaatgtgtgttttctgaacatggccttttgaccacagtagcttacaaactaggcagagagaagccagcatattatgcactggaaggttctgttgctatagcaggtgctgttattcgttggctaagagacaatcttggaattatagagacctcaggagacattgaaagacttgctaaagaagtaggaacttcttatggctgttactttgtcccagccttttcagggttatatgcaccttattgggagcccagtgcaagagggatactctgtggcctcactcagtttaccaataaatgtcatattgcttttgctgcattagaagctgtttgtttccaaacccgagagattttggaagccatgaaccgtgactgtggaattccacttcgtcatttgcaggtagatggaggaatgaccaacaacaaagttcttatgcagctacaagcagatattcttcatattccagtaataaaaccctttatgcctgaaacaactgcactaggagctgccatggcagcaggggctgcagagggagtaagcgtttggagccttgaaccccaggctttgtcagttctcaggatggaacgatttgaaccacagatccaggccacagaaagtgaaattcgttatgccacatggaagaaagccgtaatgaagtcaatgggttgggttaccagtcagtctcctgaaggtggtgatccttctatcttctctagtctgcctttgggattttttatagtgagtagcatggtaatgctaattggagcaagatatatctcgggtgtgccataataataccagctatggagtcccaagatgtaaacattttacataatgaaagcatatagcagttctgcctcttaatataatgacactattatagactctgattttgtttataaaccacttgctacatgacccatgaaaaccctagacttgtgacctgaaataaagaaaatacgttagaagagcactgtaaaaaaaaaa

SEQ ID NO: 385288 - DNA, 446 bp, Homo sapiens
cgagctcggaccgtcgcgaacgtgttatccaataacaggcttatttgaaatggtagctgttattggatgacactgagtctgaagggttaaccctatcataatttatatcaagtggactataatcactcatttttggaagagcatcgtatactaaggtgatatttgtaaacctacatgaattgtgctttgaaagaactaatttatttttaagagggcagtcctcaaatattgatcttaactattggtagtgatgttgagaatgtataaaagcagatggatttattatgtaagtcggaaaaagctaaaagtctcaatgattgtttggatgtggacattgagagacagatattaaggattgcacctgtatttctgatgtgggcatctgtgtacatgatggtactatttgctaagaacagggataacacgttcgcgagggtccggctcga

SEQ ID NO: 385289 - DNA, 607 bp, Homo sapiens
ctgggctggaggggaaaatttgggagttgtcagcatgtccatgatatgaagttatgagacttgaccagttcatccagggaatgcgtatacacagaagaaaagcattctcaggaccgcaccctgaggctctccaatgttgaaaggttggcaagataaggagaccccaacaaaggaagcagaaaaggagtggcgagtgagaagaattggggtgaggagtgtaccacagcacaggaggagaaaagtatccccagaagaagggagtgcagaagacttgaacaggctaaaataagtgtcccaatggctgaggggcacgtgaaaacgtgtttattagtcatatgggagatgcagctctaaatcacaaagaaacacaattacacaccagaatggctaaaattaaaatgactgacaatactgaatatacaaggatggggaccaactcaaactcttatacattgctggtgagggtgtaaaaggcagaaccactttgaaaagctatttggcagtttctaataaagctaaacagtgaccctttgagccagcacctacactcactagcatttactcaataaatgaaaaaaaacatgcacacgaaaactggtataaaaat

SEQ ID NO: 385290 - DNA, 417 bp, Homo sapiens
acaaatagttattcagtggcagtttacataatatatattaacagtagggtgctctttggatttccataattatttatattttaaatattttacattggaaaagtaaatagtatgcatcaaagaaaattactaatgagtttcttaagctttatcacgtgtgccctgtaattctgctttttcttcactgccttctgttccattagcaacagtaatgttcagacttgctgatgtggctgccaggttatttaatttgactaaaagtgatgtgtgataattgtgtttatttaagattttgttcagaatgtttttaaaaaggtcactatgttacttttgcattatatatagtatgactgtaaaattaacttatctagaagaattacttgtatacactaaaagttttggagacttttgagatta

SEQ ID NO: 385291 - DNA, 325 bp, Homo sapiens
cagagctagaatggggattgacttcttcttcgtggagaatggtccctggatcaatccacaggtttctgctgagcaagttttatgtattgaactctgatgaaggagggataagtggaggttttcaggtcagcatgcaagttgtatggaacatgaattatttctcaataaagctgattataaaacaaaatcagcatgcactcagcagccagaacttgcttctaaataccactctcttgataaaaggaaagccttcttggacaaatgacagatcctagggcttgggcagagaaaatagaagatgagtctggagaatcttctagtgcca

SEQ ID NO: 385292 - DNA, 507 bp, Homo sapiens
taatgatacagagcatcaatggtaagtttcttacagtatacagaaatatatacttgattgatcaaattacaaaatattcctacaaaatgaaacatggcatatgcttcttatgtgagaaaaacaatattagctagaaccgttgtgtggagctatggagttcataccctttgctgacaggttaggaaatacgtgaaaggcaaagctgaacataagtgttcctgaggtctatgtctttatacagcattatacaaagtaacatttaattagcaataataatagcaacataagaatatctaaactgtaaagaaaatataactgtaaagattagttcaatttttttcttttaagttattaatttattatttgccttatagtgcgtgatctggttgtactagtctaaaactgttaagaaccaaactctgacatcacacataggtattagttatagttcaaacactgactaggctacctaatttaaataaactcgtttccttattggtcaatgag

SEQ ID NO: 385293 - DNA, 2196 bp, Homo sapiens
  misc_feature (1)..(1): n is a, c, g, or t
  misc_feature (4)..(4): n is a, c, g, or t
  misc_feature (8)..(8): n is a, c, g, or t
  misc_feature (11)..(11): n is a, c, g, or t
  misc_feature (14)..(15): n is a, c, g, or t
  misc_feature (17)..(21): n is a, c, g, or t
  misc_feature (23)..(23): n is a, c, g, or t
nttnttanaanctnngnnnnncncaccactgaagatgaggttgaaaaacctgacttttatcatcatattgataatctcaggagaactctatgcagaagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcaaaaaatgcactaagcctgacctgagtaatggttacatctctgatgtaaagttattgtataaaattcaagagaacatgcattatggttgcgcttcagggtactcttctcaaccaacctgtaggaaagaacatgaaacgtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccaaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattgaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttgaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttggaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttagagccatgcacattatcttttactgaaatggaaaagaataatttacttctgaaatgggattttgacaacagaccacacattttgcatggtgaatatattgagtttatttgtagaggagatacttatccagctgaattatatattactggatctatacttagaatgcaatgtgacagagggcagttaaaatatccaagatgtattccaagacaaagcaaacaaacaactggaagtggtaatcaattcaacaggccttctgaattgtctgaagtgaaagcaacgtttgccatttgatatttgtgacactttggcaaatggaaaaataaaccaatttatacgtgcaatatttcaatgtgcaaaaattaacctatatgttctgtgataaggacaaaaatcacactttctcctacttctcaatataagttcaagcactactaataaaggttggatactaaagtgtttcctcatatgacagttta

SEQ ID NO: 385294 - DNA, 2207 bp, Homo sapiens
  misc_feature (1)..(1): n is a, c, g, or t
  misc_feature (4)..(4): n is a, c, g, or t
  misc_feature (8)..(8): n is a, c, g, or t
  misc_feature (11)..(11): n is a, c, g, or t
  misc_feature (14)..(15): n is a, c, g, or t
  misc_feature (17)..(21): n is a, c, g, or t
  misc_feature (23)..(23): n is a, c, g, or t
nttnttanaanctnngnnnnncncaccactgaagatgaggttgaaaaacctgacttttatcatcatattgataatctcaggagaactctatgcagaagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcaaaaaatgcactaagcctgacctgagtaatggttacatctctgatgtaaagttattgtataaaattcaagagaacatgcattatggttgcgcttcagggtacaaaaccactggagggaaggatgaagaagtggttcaatgtctctctgatggatggtcttctcaaccaacctgtaggaaagaacatgaaacgtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccaaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattgaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttgaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttggaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttagagccatgcacattatcttttactgaaatggaaaagaataatttacttctgaaatgggattttgacaacagaccacacattttgcatggtgaatatattgagtttatttgtagaggagatacttatccagctgaattatatattactggatctatacttagaatgcaatgtgacagagggcagttaaaatatccaagatgtattccaagacaaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcattatttataaatgaaaaccaataaatgtctaatttttagtttgt

SEQ ID NO: 385295 - DNA, 482 bp, Homo sapiens
acccatcaagttccctgggtttgcatgtgcaatcgattcctcgttagggatattctttcctctggtttttccttcagatacgagcttacgttcgacctcttccaagaagacgtcaggaatgtccttctgaatgcctttcctagttctcatgagaacacagcagtttttaatcaggcagagcacttattacattataattatcttcttggttcccaactgaacttttaagttccaagtgggcagtcagtaaatatttcttggtgcatcaaatgctccacattttacacagttaacgtttgctgcctacaaaccaatttggatagttactttaaagtatcttatctctagttctcaaagctttagtttcctttaacacttaagtatctcttgcatattttcttttcaaacactgcttcgttaatttgcaaattcattggactcctttccttaaaaatcaaaataataaaacttcaagaaagctg

SEQ ID NO: 385296 - DNA, 236 bp, Homo sapiens
ctcaaaaaaaaaaaaaaaaaaattacacatagttatatgtgtgaaggcttagtatatatagaaaactaataaatgtcagctgcaatgattttttaaaataattcaattattttgcaacattccttcagttaatttgacaacattcatgtttattaaatcatatttattttcattaaaatacaaggtatctgcagtgagccgagattgcaccactgcactccagcctgggtgataga

SEQ ID NO: 385297 - DNA, 418 bp, Homo sapiens
gtggtaacttagaacacacaggaaaacaatatcaaatatcaattccctccagagttgtaactttctaaatgtagtaatcagtaatttgtcaagattatcattcagcatacaaatactttctatataatttgaacttccataccaccttctatatcaagtccttaaatgctaccaaatataaaccaggtattgttttcatgaaataagaatacaggtgttaaagatgaataaactgagacattaaagagattaagtgtcttgctttaagggggtgggggaggcaaggtcaaactaagaatagaagctcaagtactatcacctgtcctaagcataaatctaaaaaactttccactttccgactagccataagtacatggtcccatcaatttttatgtattttaaacatacattttgcagg

SEQ ID NO: 385298 - DNA, 495 bp, Homo sapiens
ttggagacagagtttcactcttcttgcccaggctagagtgtaatgacgggattttaccatgttgaccaggctggtcttgatctcccgacctcaggtgatctgcccgcctaggcctcccaaagtgctgggattacaggcgtgaggcaccgcaccaggcctgtatttttagtagagatagggtcctgccatttagccaggctgatcttgaactcctgacctcaggtgatccacccacctcagccaaagtgttgggattacaggcgtgagaatcacttgaggccaggagtttgagaccagcgtgggcaacgtgacaagacccagtctctacaaaaaacttaaaaattagctgggcatggtggcacacacctgtggtcccagctactcagggggctgaagtgggaggatcacttgagcccaggaggtcaaggctcaatgagctaataatcctgctactacagtccagtcttgacaacagagtaagaccctgtctcgaaa

SEQ ID NO: 385299 - DNA, 283 bp, Homo sapiens
gtctcccctgtaaggatacctagttaacaccttcataagaaacaaaatcaggtgagcactcatagtacctgtttttaacttaatatggctgaaagaggtactgaagagatagaaaaaaagagtcctgaattgctgatgccacccctcccacacccccagcagcagcagcagcagcagagtggtgcagagagaatctatgtgctgggagatggaaagcacagcaattgtgagtcattgaactcagtgcttttctgttagagcaaaaagaaaaacagaccaaact

SEQ ID NO: 385300 - DNA, 788 bp, Homo sapiens
tgcagaaaaaaaaaaatccatcctaatatggaatcacaagtgacctggaatagccaaaagcatcttgaaaaagaggaacaaaattgcagtctcatacttcctgatttcaaaacttaccacaaagctacagcaatcaaaacaatgttgaattagcataaagacatatttataaaacaatgggaaaagataggccagaagtaaagcctcacatatatggtcaaggggccagggtatcacccttttgacaagaatgccaagaccattcagtgggggaaaagacagcttcaataaatggaactgggaaattggatatccacatgcaaaaagaatgaagtcagacacttatcttatacaatatacaaaaattaactcaaagtggatcaaagacctaaatctaagggctagaattataaaacacttaaaagaaaagataggtgaaagcttcatattaggcaatgatttcttgaaaatgacaccaaaagcacaggcaacaacaaaaaataaggtggactacatcaaaactttaaaaacttctgtgtctcaaaggacacaatcaacagagtgaaaaggcaaccaagtgactgggaaaaatatttataaatcatataactgataaggggttaatatccagaatatataaagaactcctataactcaacaataaaacaaataacctctttttaaaaaatgggtgaaggacttgaatacacatttctcaaaggaagataattagggaaacacaaataaaaaacataaagaaatatcactttacacccattagggtggcc

SEQ ID NO: 385301 - DNA, 304 bp, Homo sapiens
gctaattttaaacttcctagtagccacattttaaaaaatgaaaataaacaagtaaaaatagctttattaatataattaatatagccaatatattgaaaatgttttcatttcaacatgtaattaatatttaaaaattaatattaaaatcattgagatatgttactttttgaatactaatcaaaatctagtacaggtgtatatacatcacgtcattacttttctttttgaagttttatttatttatttatttatttagagacagtctcgctctgtcacccagactggagtgcagtggtgtgatctc

SEQ ID NO: 385302 - DNA, 339 bp, Homo sapiens
cttttctaagagacaatgaattatttccctgctgttgacatatcagctgactttacattttttcttcagtgagttttgtgaactcagaacagatttttctctccattccctttttgttatatgcaatcattgacaatgccagtagatgaacacccagctaggaaacaatggcttaatgaatacctgtattcatgctctgctttaggaaaaggaaagaatgcctctcctagcctactcctgcaaactgattcacaccaaggacaaaggtaaccagtctgggatagaaactcagccatagcaatgagcagccttagtgtttctcaccttagtttgctcagc

SEQ ID NO: 385303 - DNA, 578 bp, Homo sapiens
gtagcccatagcagattattcctcccctacttttgtttcccaccctctcctatgactcaccttccactttttcaccagttcacagtctgaactgcaaagcaacctagaggcatcaagcaaaatgagaaagaaggaaagcaagtactatttattaaacacccactctgtgccaaacttgtgactaaattactttattaaatcctcacacagctgaggatatagatctttatcttcagtatatagatgaggcagctgaggcttaaggagattaaataacttgcccaggatcacacagctaccaagtatcagagctggttttcgaatccagttttatctgatgccgaaacccagtgtttcccttccaccctgcttcccctttgaaaaccaggaatgaattcacatagagaatcagaccttgaggagttgagttgttctctattttctaaagaatttagtttataccttcaaaagggcttccctttgtcttgagatattctaagttccaagtagtctcaagtggtttttgtagcaggagctagactggaaaaactctagagctttgtatttcattataagca

SEQ ID NO: 385304 - DNA, 500 bp, Homo sapiens
aaggacaggaggtcattggggattttagaaggttacactggatacatttccattaagcttcacgatatcccacaggtccattctgtgtgaaatggtctaaaaatttcctgttctcatgcttcatttttttcttttagtaatattcctaattgtgtaaaatagtatttcttttcatttatcttaattatgttatattaagatatcatgtgtatgcttaaattatacttttgggcttcaaatgagtgaccccacccagaccttcttccctctccccgaccaaagccgtctttagctttctgaaaccagctgatcaagttgtttttacttgctcattcctatttacctatttagcattgcatgcactttaattatttattttttgagacaaagtctcgtgccctcacccaggctggagtgcagtggtgctatctcagctcactgcaacctctgcctcctgggttcgagcgattctcctgcctcagcctcccaagtagcttgga

SEQ ID NO: 385305 - DNA, 424 bp, Homo sapiens
cctttgttgcaattcacctatggaggcctgccaaaggctgcaaacattatccctatctgccactgacacctcaagtacgcttggagctgctaggtcatatggcccaagtggcagagcagcttgcacagcagcctagacctgttgtggagccttctcctgctttagaccctactcaaaactagcagctttttgagttttttggtaaatgagctagaatttaccaaatggaatttcacccctgtggtttgaatgtctcccctctaaaattcaggtcttgccaattagatagtattaacccttttcctgtttagaattttaaaaatgcagctcatggccagcactcatttaattttacttaaacatgctctttgaggctgcagcaaatctgacttgattttccaatgtgaaaataaaatataaaaac

SEQ ID NO: 385306 - DNA, 339 bp, Homo sapiens
agccaagcaacagcctcctggaccaggcacaagccttttggggggcagtgccccatccctaggattccctagctgctgtgtagacctgagcctatacctgccgccaccccgagcactgatgggacacagcaggtggcaacgggatgcccaggctcctactctccttgctcagtctgccccccgataggcctttgacttgtgcttcccctggcaaagctaccttgagtccttagaaatcccccctgagaagtacagaaggcccccccccacagggatatgctctgaaataactcagctcagaaatagctactaagtgggcctgaatagggagtgtgggag

SEQ ID NO: 385307 - DNA, 1761 bp, Homo sapiens
atctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaaggatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattcacctgtggatgtttttgagtaaataaaagctaatagctaaaaaaaatgta

SEQ ID NO: 385308 - DNA, 2255 bp, Homo sapiens
atctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattcacctgtggatgtttttgagtaaataaaagctaatagctaaaaaaaatgta

SEQ ID NO: 385309 - DNA, 413 bp, Homo sapiens
catggtaaaaccctgtctactaaaaaatacaaaaaaaaaaattagctgggcatggtggtgcgtgcctataatcccagctacttgggaggctgaggcaggaaaatcgcttgaacccgggagactgaagttgcagtgaggtgagattgcaccactgcactccagcctaggcgattccatctcaaaaacaataacaacaaaataacattgttggaatatttagttaatttatagaagcgtattggcctaattggggcaaataccttattctgacattctctctatttgctttactgagctttttcaccagtggaatttaagcccttgatacatgaggagggaaaataccttggagctgtgctgcacatgtaaagtacacaggagatttagaaaacttcgtagcaaaaaaaagagtg

SEQ ID NO: 385310 - DNA, 278 bp, Homo sapiens
caatattaaaatagcaccgtttattgactttaatatgtgacaaccactgtgctgagctatgtatgcttcccttattcaatctatgtaaaaattttggggaagtagctgagacttttttatttccctgacagagctgggattcagtggttggtttcttgaaaaagctaggttctttgcctaacagcagcttagctcctcaatttagggaatgaaagcaggaatgaaaatggccagagttttcgctcctcagcttgtggaggagcttgagtacatgaacc

SEQ ID NO: 385311 - DNA, 412 bp, Homo sapiens
tagaaaacctgagtggccctatatgtactgaagaaggttaatatgtaataaaaactttcccagaaagaaaacttcaggcccagatagctttcctggtgaacggtatacattagggaagaaataataccaatttgacacaaattcttccagaaaattgaaaaggaggaaatattttctagcccattttatgaggccagcattaccttgatacccaaaccagcaaagacctcacaaggaaagaaacctcggaccaacattctacacggatgtagatgcaaaaaatttaaacaattttgcaaatgcaataatatataaaaaggataatacatcatgactagggggacttagctcaggaatgcagggttggtttaatgttcaaaaatcaatcattgtaattcactatattaaccaa

SEQ ID NO: 385312 - DNA, 245 bp, Homo sapiens
gatctaagttctaagccaaataactaacaaattccaggtactatgccatcatataatatttataaatgtgttatatatattatgagatatgtataagaatatagaatgaatatgtaataaattatacttttaaattaatattttcaaatatataaatatgtagtttcagactgaaactgttctaaactatataaatgtattatgtatgttttataaaatacagtactcataatatgtattatatg

SEQ ID NO: 385313 - DNA, 110 bp, Homo sapiens
aagcaattcgcccacctaggcctcacaaaatgctggggttacaggcagaagccaccacacctggcctaaaaaatatgtttaaaggtggctgaggcttgctggagtgcagt

SEQ ID NO: 385314 - DNA, 556 bp, Homo sapiens
gctgataaaaagtgagttccagtgtgaatccactaaacagttgacccttaaacatgggttggaactttacatggattttcttccacctctgccactcatgagacagcaagaccgaccccttttcttcttcctcctcctcaggattttctcaatatcacttgcttttctctagcttactttattgtaagaatacaatatataatacctacacaaaatatgtgttacttggcagtttgttacaggtaaggcttccagtcaacaggaggctattagtaattaagtttgggggagtcaaaagttgtacatggacttttgactgcagggggtcaatgcccctagcctgcatgttaagagtcaactgtacttacattttaccccagaaagaataccaattatctaataggattttttgtctttcttttcctttcccattcctttcttctttcctttttctctccgattcagttaagtaaataaaccaaaagactctcatgagtatttgggggattgaaatacaatagtctcgagtctcaatcgaccacactcaggataggag

SEQ ID NO: 385315 - DNA, 742 bp, Homo sapiens
gggtccttccatccactttctccctcccatccaaggggcatgggggactgaaaggataaggaaacacatgaagagacaataccaaattcaggacgaaccagacagttttgcaaactgaacatcttcctggcctgggacatggacgttggctctgacaacacagactcaatagctaataggcttctaaatggagccaacctgtggataaacaagttcccaaaagagaggacaaaactatctgtcagcaaactgaataatcttgtgcaagagtttcagacatttctagaaaatctgaaagacaatgaagatgatgatgctgtgtttcctgaaactactcagatttccagctgtacggcagctcccctccagaaatggttcaggtcagtcatcaagaacatgatgcttgtcaagacctgcccaagtgcaagccaccagaaaataaagatgttatgtagtctccacagactcctctaaggcttaaggaacatgagctggctgaggtgagcacagagatgcctcataggataggaagggataggcctgggttgaaccacagaatcttacgaccactaggaagcaggtcccaaggggcccgaagtgataccagtgggagacagacaacgaagaaaggagtcagggtggagttttagggaaaagactgaggaatgctgaggtaaacaagagggtagcaagcaaggagaaggactaaaaactgtatctacattgaagctttgcattgaca

SEQ ID NO: 385316 - DNA, 291 bp, Homo sapiens
ggtgccaaaaggttggagaccactgttgtcaccaatataatttcacatttgccatatcttaatttcccattgatgcctaatagttacctgaagtttctccctcagatgcttaactagctgggatcatatacttgggtcagacccattagtaggggagaagaagggcagtttataaaagccatttagctgatcctgaccagcatttttatttcttattttattttattattattttcttcaagactgagtctcactctgtcgcccaggctggcgtgcagtggcgcgatcttg

SEQ ID NO: 385317 - DNA, 363 bp, Homo sapiens
  misc_feature (1)..(2): n is a, c, g, or t
  misc_feature (4)..(4): n is a, c, g, or t
  misc_feature (208)..(208): n is a, c, g, or t
  misc_feature (210)..(210): n is a, c, g, or t
  misc_feature (344)..(344): n is a, c, g, or t
  misc_feature (351)..(351): n is a, c, g, or t
  misc_feature (361)..(362): n is a, c, g, or t
nnangtgggagacagatggatttcagtgggatgtcattatgaaaagcatataaccttctccaaataattaaaagcagcaacaaaagacaaaaagaagaaagccatttgaataaaaattaaccttataaatgcaataaacattttaattcctttaacaacaaaaggttgggagcatgttgaaagaacccagaagccaacctgaaagagntntctcaagcagtctctaagcagcagtgactactgcagctattggctggtaagaacaaagcaagcacaaatggactgaaacagtttatgccttacatagaccacatacgcaagatcaccatagtgtcagctgcctntatctcntctcccacanna

SEQ ID NO: 385318 - DNA, 758 bp, Homo sapiens
tcctaattggggcaatccattcttttctcgatttctttccaggatatgtgaggacgcagatgtctggtaatgaggtaatgtctctttttccttgtctttgagtggcagatcattctcccggttctttggccagagggagatgacatgggggtagggaggagtaaggttgctgctgtctggatgggactgtcccctgagtctctggaacggctgtggggggtggtgaggctgcctcctgagaccttcatcactgtgcctccaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtacatttta

SEQ ID NO: 385319 - DNA, 1689 bp, Homo sapiens
  misc_feature (979)..(979): n is a, c, g, or t
ttcggcaatggcgggcgcccctcccccagcctcgctgccgccttgcagtttgatctcagactgctgtgctagcaatcagcgagactccctggggtaggacctccgagccaggtgcgggagatagtctcctggtgcgaggatttttaagccggtcggaaaagcgcagtattcgggtgggagtgacccgattttccagacaggtgaagacagaacaagaaaacaaaccaagaatttcccctcaccagccaccagctctgccagcaacttgatcttagacttcccagcctccgtaacgcctctgcttataatctgtcatggattggaaaactagaaaaagcagtttacagagtataacaaactttggaggagttaatcgactctaagtaaaagagtatctagcacggctgtggaacaaaggagagactcacaaactgttgaaagaataaatgaatgaatgaattctgttcatgagctttaataaaacagctctgagtagtaacagtggatcaaatttaggcttcttgatgcaggcatggtgtagattactacttctgtattgtcccaggagctcagcacattcctgcagagatgataggagctcatctgatacttgtcagctttgaataaactccagtccccaagagagagaatgagaatcaccggaatacagaaacttccctgttggacttcccaacattcttgaatgcaccaagatagcctcttgctgtgagattaataaatgaataaatgcctccatatttttcaaatctgtgaagttaacaacatgtagattttctttgcatatttaaaaactgcaactaaatcttaatgcctctgaagcagatggaagaaaataataggcttcccattaactgtgtcaaattgtataggtcttggccatcactggtcctgtttgtgatgaaggtttttgcccttggatataattttaattttcaatttcttctaatagggacttcanacatcaatattgaggatgaacttctctagtgtcaaggactgattgagttgtgtaacccctgaatatctgagacaggtctcgattattttagaaagtttatttgccaaggttgaggatgtgtgcctgtgacacggcctcgggaggtcctgaggacatgtgctcaaggtggtcagagcacagctttgctttatacattttagagagacatgagacatcaaccgacattatgtaagatgaacatggttccatctggaaaggcgagacaacttcaaacgaggagggggcttccaggtcataggtagataagagacaaatggctgcattcttttgagtttctgattagcctttccaaaggaggcaattagagtgagcaaaatgaacaaaatcaattattttgattctgaacaaaatgggaggctggttttccctaagcagttcccagcttgacttttccctttagctgagggatttggggggcccaagatttatttttctttcaccgttgtatcaaactacacagcggccttggaaaccatcacagttgagagtaggtaacacccatttgttgcatagttttgtgctccacactcttatctacaaaattatgaatttttttacatatattaatttcagaaaaactaaaaataaaacaaagtagtttcaaactagtattgtttttatatcttaaaaataaagctttatatactctc

SEQ ID NO: 385320 - DNA, 1837 bp, Homo sapiens
  misc_feature (1127)..(1127): n is a, c, g, or t
tcacgcccggctgcttttttgttttagtagagaggaggtttcaccgtgttagccaggatggtctcaatctcctgacctcgtgatccgcccgcctcggcctctcaaagtgctgggattacacgcgtgagccaccgcgcctggcctgaagaaagtaggaagaagaaaagctttttgaatgaatcacttctcatcttctccgaagttggaagcatcaagaatctaaataagcatttatgacggctggcatgaatatgcggaagatagaatgggagtcctagttgaccttcatataatttttagaagatggagcacttcaacttcttccactcatgaaaagagaggtgacaggtgaagacagaacaagaaaacaaaccaagaatttcccctcaccagccaccagctctgccagcaacttgatcttagacttcccagcctccgtaacgcctctgcttataatctgtcatggattggaaaactagaaaaagcagtttacagagtataacaaactttggaggagttaatcgactctaagtaaaagagtatctagcacggctgtggaacaaaggagagactcacaaactgttgaaagaataaatgaatgaatgaattctgttcatgagctttaataaaacagctctgagtagtaacagtggatcaaatttaggcttcttgatgcaggcatggtgtagattactacttctgtattgtcccaggagctcagcacattcctgcagagatgataggagctcatctgatacttgtcagctttgaataaactccagtccccaagagagagaatgagaatcaccggaatacagaaacttccctgttggacttcccaacattcttgaatgcaccaagatagcctcttgctgtgagattaataaatgaataaatgcctccatatttttcaaatctgtgaagttaacaacatgtagattttctttgcatatttaaaaactgcaactaaatcttaatgcctctgaagcagatggaagaaaataataggcttcccattaactgtgtcaaattgtataggtcttggccatcactggtcctgtttgtgatgaaggtttttgcccttggatataattttaattttcaatttcttctaatagggacttcanacatcaatattgaggatgaacttctctagtgtcaaggactgattgagttgtgtaacccctgaatatctgagacaggtctcgattattttagaaagtttatttgccaaggttgaggatgtgtgcctgtgacacggcctcgggaggtcctgaggacatgtgctcaaggtggtcagagcacagctttgctttatacattttagagagacatgagacatcaaccgacattatgtaagatgaacatggttccatctggaaaggcgagacaacttcaaacgaggagggggcttccaggtcataggtagataagagacaaatggctgcattcttttgagtttctgattagcctttccaaaggaggcaattagagtgagcaaaatgaacaaaatcaattattttgattctgaacaaaatgggaggctggttttccctaagcagttcccagcttgacttttccctttagctgagggatttggggggcccaagatttatttttctttcaccgttgtatcaaactacacagcggccttggaaaccatcacagttgagagtaggtaacacccatttgttgcatagttttgtgctccacactcttatctacaaaattatgaatttttttacatatattaatttcagaaaaactaaaaataaaacaaagtagtttcaaactagtattgtttttatatcttaaaaataaagctttatatactctc

SEQ ID NO: 385321 - DNA, 1953 bp, Homo sapiens
  misc_feature (1243)..(1243): n is a, c, g, or t
tcacgcccggctgcttttttgttttagtagagaggaggtttcaccgtgttagccaggatggtctcaatctcctgacctcgtgatccgcccgcctcggcctctcaaagtgctgggattacacgcgtgagccaccgcgcctggcctgaagaaagtaggaagaagaaaagctttttgaatgaatcacttctcatcttctccgaagttggaagcatcaagaatctaaataagcatttatgacggctggcatgaatatgtctataggtccactgatacggctttgctactctaccccgacaccctgaggactaatctattaatagtatgtacttcttataatgatgagtgaggcacaaaagaggaagcagaaacgcggaagatagaatgggagtcctagttgaccttcatataatttttagaagatggagcacttcaacttcttccactcatgaaaagagaggtgacaggtgaagacagaacaagaaaacaaaccaagaatttcccctcaccagccaccagctctgccagcaacttgatcttagacttcccagcctccgtaacgcctctgcttataatctgtcatggattggaaaactagaaaaagcagtttacagagtataacaaactttggaggagttaatcgactctaagtaaaagagtatctagcacggctgtggaacaaaggagagactcacaaactgttgaaagaataaatgaatgaatgaattctgttcatgagctttaataaaacagctctgagtagtaacagtggatcaaatttaggcttcttgatgcaggcatggtgtagattactacttctgtattgtcccaggagctcagcacattcctgcagagatgataggagctcatctgatacttgtcagctttgaataaactccagtccccaagagagagaatgagaatcaccggaatacagaaacttccctgttggacttcccaacattcttgaatgcaccaagatagcctcttgctgtgagattaataaatgaataaatgcctccatatttttcaaatctgtgaagttaacaacatgtagattttctttgcatatttaaaaactgcaactaaatcttaatgcctctgaagcagatggaagaaaataataggcttcccattaactgtgtcaaattgtataggtcttggccatcactggtcctgtttgtgatgaaggtttttgcccttggatataattttaattttcaatttcttctaatagggacttcanacatcaatattgaggatgaacttctctagtgtcaaggactgattgagttgtgtaacccctgaatatctgagacaggtctcgattattttagaaagtttatttgccaaggttgaggatgtgtgcctgtgacacggcctcgggaggtcctgaggacatgtgctcaaggtggtcagagcacagctttgctttatacattttagagagacatgagacatcaaccgacattatgtaagatgaacatggttccatctggaaaggcgagacaacttcaaacgaggagggggcttccaggtcataggtagataagagacaaatggctgcattcttttgagtttctgattagcctttccaaaggaggcaattagagtgagcaaaatgaacaaaatcaattattttgattctgaacaaaatgggaggctggttttccctaagcagttcccagcttgacttttccctttagctgagggatttggggggcccaagatttatttttctttcaccgttgtatcaaactacacagcggccttggaaaccatcacagttgagagtaggtaacacccatttgttgcatagttttgtgctccacactcttatctacaaaattatgaatttttttacatatattaatttcagaaaaactaaaaataaaacaaagtagtttcaaactagtattgtttttatatcttaaaaataaagctttatatactctc

SEQ ID NO: 385322 - DNA, 1643 bp, Homo sapiens
  misc_feature (933)..(933): n is a, c, g, or t
tcacgcccggctgcttttttgttttagtagagaggaggtttcaccgtgttagccaggatggtctcaatctcctgacctcgtgatccgcccgcctcggcctctcaaagtgctgggattacacgcgtgagccaccgcgcctggcctgaagaaacaggtgaagacagaacaagaaaacaaaccaagaatttcccctcaccagccaccagctctgccagcaacttgatcttagacttcccagcctccgtaacgcctctgcttataatctgtcatggattggaaaactagaaaaagcagtttacagagtataacaaactttggaggagttaatcgactctaagtaaaagagtatctagcacggctgtggaacaaaggagagactcacaaactgttgaaagaataaatgaatgaatgaattctgttcatgagctttaataaaacagctctgagtagtaacagtggatcaaatttaggcttcttgatgcaggcatggtgtagattactacttctgtattgtcccaggagctcagcacattcctgcagagatgataggagctcatctgatacttgtcagctttgaataaactccagtccccaagagagagaatgagaatcaccggaatacagaaacttccctgttggacttcccaacattcttgaatgcaccaagatagcctcttgctgtgagattaataaatgaataaatgcctccatatttttcaaatctgtgaagttaacaacatgtagattttctttgcatatttaaaaactgcaactaaatcttaatgcctctgaagcagatggaagaaaataataggcttcccattaactgtgtcaaattgtataggtcttggccatcactggtcctgtttgtgatgaaggtttttgcccttggatataattttaattttcaatttcttctaatagggacttcanacatcaatattgaggatgaacttctctagtgtcaaggactgattgagttgtgtaacccctgaatatctgagacaggtctcgattattttagaaagtttatttgccaaggttgaggatgtgtgcctgtgacacggcctcgggaggtcctgaggacatgtgctcaaggtggtcagagcacagctttgctttatacattttagagagacatgagacatcaaccgacattatgtaagatgaacatggttccatctggaaaggcgagacaacttcaaacgaggagggggcttccaggtcataggtagataagagacaaatggctgcattcttttgagtttctgattagcctttccaaaggaggcaattagagtgagcaaaatgaacaaaatcaattattttgattctgaacaaaatgggaggctggttttccctaagcagttcccagcttgacttttccctttagctgagggatttggggggcccaagatttatttttctttcaccgttgtatcaaactacacagcggccttggaaaccatcacagttgagagtaggtaacacccatttgttgcatagttttgtgctccacactcttatctacaaaattatgaatttttttacatatattaatttcagaaaaactaaaaataaaacaaagtagtttcaaactagtattgtttttatatcttaaaaataaagctttatatactctc

SEQ ID NO: 385323 - DNA, 476 bp, Homo sapiens
ttgttccccacctgtcatcactcaatacacaaaacttaaagaattagtctctaaactcccctaatccttcagtcctaaaatcttctattggtcaacctgattagattacacggacctgcaaacacagatgtcagacacagcacaccaaatacacaattaaacccttcttcaggaatatgtggacaagacctcctaagtaatctcagtggcaggagtggtagcatctttatctgaccacatctttcccattagctcctacaggcatgccttcactttcctaaaaatatcccattatgagcaaactcttcccctgacacctttataattttttccccataaactcaataaagtagtatcaccctactttaagtggaaaaagtccaaaggtcaccaaccttttcttttggcagtgaggacagcaacaagcatcaacaagccttgtgaagacacaaaagattttgcactctggtgtagag

SEQ ID NO: 385324 - DNA, 457 bp, Homo sapiens
gtgggcaggggaagggtggagggagctgggcaccctgcagatggcagggtgggtgctcagtgccatggggctgccaccatcctccaagtgtggccccgagggccggagctgctctccctccattgctaggcgtaatcagttccttgtgcctggctctgcccaggaggtgtatattggggggcatgaatgtagggccagcccagctggccagtgaccctctgagcacagagccttcgggatggggctgggggtgtcccccacaacagagttcccttcctgagatgcgctggtggaggagggggcagtctctggaatttctgtttggagactttccggaggcgtgttcagacataaaatcacagcagcagcagtcagttttcaagcaaagagacttctctgggcatctctgagacgagtttgagcagtgtggggattcgttttgggagcacggcctcac

SEQ ID NO: 385325 - DNA, 443 bp, Homo sapiens
acacggttgactaggctctggttaaatcccagtattgcaatttactttatgtcaaagggaacaagcaaaatgctaatgcctaccctctcagacaaaccttcctaggcaatggagggggtgtagaaaagggtgtactttctggactaatggtgtacttggtggacttcacttttaaatgatcaaccacttgggaggcggaggggagtggatcacaaggtcaggaatttgagaccagcctggccaacatagtgaaaccccatctctactaaaaatacaaaaaagtagctgggtgcggtggcaggtgcctgtactctcagctacttgggaggctgaggcaggagaatcacttgaacctgggaggaggcagaggttgcagtgagccaggatcgcgccactgcactgcactccagccccagcgacaatgcgagattctgtctcaaaaa

SEQ ID NO: 385326 - DNA, 256 bp, Homo sapiens
ccgcgtgactgagggtggagggggccctgtctcggaagactgcgtcagtcatgagtcggtgcagccctgaattagcgctctacatcctgaaagatgggtttgacctggtttcctctgaaaaatagggaagcaggtcaggttttaacaactcgacatagaaatacctcagctctggctgggaggactggctgagatgtggaccgacaaggcacattctgtggggaccacggctcagccccgtgagcagaggtgggtg

SEQ ID NO: 385327 - DNA, 338 bp, Homo sapiens
tggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgca

SEQ ID NO: 385328 - DNA, 346 bp, Homo sapiens
tggctgattttaaaatttttttgtggagacagtcttgctgtgttgcccaggctggttatgaactcttggcctcaggcagtcctcatgcctcagcctccctaagtgctcggattataggcatgccactgtgcctggccaaaaatacagattttttaatagatattactatggctcctattcttaaaggaaaaaatatgacattttaagactatatgcaagggatattccaataatatcttttttatttaaaaagccactaattagaatcagatttcattaggcaagtgaaatccagattttactagccagaaactgccaggtgtagaaacagcaagaacattttagt

SEQ ID NO: 385329 - DNA, 577 bp, Homo sapiens
acgtgacaatttatttcccgtggccaagctctcttggctttcctctccttcaagctcctctacggcaccctctagaatagctttcccaaaggtaaacacccaccccttggctgacatcctcgcttggctgtcacagtgcacttctcctgaggggtccttcctacctcatggtcatatcttctctacctgctttcctggacctcctatgtccctgacaagcctcagggctgattctgatgttctttcctactcactccctcattgtattagtttcttggggctgccataacaaagtgccacaaacttgggtgatgacagcaacagaaacatattctctcacagttctggaagtcttaagtctgaaatcaaggtgctggcagggccatgttctctctgaaggctgtgagggagaatcttttcttatctcgtttcaggtgcttgctggcaacacttggcattccttggcttgagttgcatcattccactctctgccttcatcacttcacgttttttcctctgtgtatctgtgtccaaatttccctcttcctttaaggataccagtcatactggatttaca

SEQ ID NO: 385330 - DNA, 593 bp, Homo sapiens
cttggctaatttttgtacttttgtagtagaaatgaggtttcaccatgttagcccggctggtctcaaactcctgacctcaaatgaacttcccaccttggcctcccaaagtgctgggattacaggcgtgagccaccaaacccagcccaaaataatgaaattattttaatgttatgaattacatctgaaaacaagtttgattaatacttacatatttgagttatgtaattttctcactgtcattttctttaaaagatactatcttgcatttgtattcttcattgatcaggagagtgttttccatttcggagtgatctagggctctgcttcaatgtttactattaatattaaatcctagtttctttgggtttgagtaggagaatgaggtctgcttatttcagctttgaaaaattagttgattttttgcgatctaccatataatcctgtttttataaatgtttcatgaatgttttaagaggtacagcctttttttcctacagcattctgtatattatctgttattttctgtgtgtatggttaataatctagtaattgcaattgtactactgaaattttcatcttgaaagacaacatgg

SEQ ID NO: 385331 - DNA, 370 bp, Homo sapiens
tggatgggttagtgggtggctgggtggatagatggatgggtgattgggcgaatgggcgaatgggtggatgggtgggcgtggagttggtgggtacatgataatggggtggaatacccatggattggaatgagctgttttggctgctatttctgggacacccagctctgccaggcccctacccctctggtgggccaggctctgacggtggccactcatggcctttctagctctggtgccagcatagggaaggaggaggcacagccttgtcttactccttgcacctgttagcccccccccccgccaagggaggacccgtggttggggacagcacagggggccctgctgtgtgcagggactgtccctggggcca

SEQ ID NO: 385332 - DNA, 485 bp, Homo sapiens
cagtgagcaaggctctgtgggcatgggacccactgagccaggcacaggagaaaatctcctggtctgctggttgctaagaccgtgggaaaagtgcagtattagggcagaagtgtcccatttttccaggtacagtctgtcactgcttcccttggctaggaaagggaaatcccccaaccccttgcgcttcccaggtgaggtgatgccccgccttgctttggcttgccctccgtgggctgcacccactgtccaaccagtcccaatgagatgaaccaggtacctcagttggaaatgcggaaatcacctgtcttctgcgtcagtcatgctgggagctgcagatcggagctgttcctatttggccatcttggaacagaaaccccacttgaaagaatttgtgtacatgaaaatttttaaaaatccctccatttcctaatctatgatagaatatatttcaaaaatttggtggtaagccaatttttggaaaaaaa

SEQ ID NO: 385333 - DNA, 136 bp, Homo sapiens
tcaggaagcaaggcttgggaacagtcccttcagggctcacctgtactccagcaagccaggtatgacctaaaacctctgtagaggacaatttgccaatagctgtcaagttccaagagccatcttccccttgacccag

SEQ ID NO: 385334 - DNA, 533 bp, Homo sapiens
tgtttgcaacaagtcatccttcatcctccagcctggcctcaggacgggtgaaataccctaggacatacttccatctggagttgccttcccttggcaagggaagagggaagaaggagcttgatttcttgagttcctatgttgtgcaagatagtttgcaaaccataagtcctgataacatctcaagaccttgggaaatacaattcatcacactgatttgatgtgataggtgaagaatacaaggtgaagtgttttctccaagaccaggatcttcatgcaggcctatctgatcttaggcttcagctctttatcttacaccttgagaccccaagagagtcccaaattcctggaaaggcagcatcacagagtggggaaatacaggacttggctttaggttctagtccttaacacagcttcttccttgctgtgtgttctttggtaggtcactaaatctctctgagcctcaaatttcttatctctaggttgaaaaataaaataaagtccccatgccaatcagtgcaaggaatctgtgagat

SEQ ID NO: 385335 - DNA, 342 bp, Homo sapiens
ctctgcctgttactttccggccagagcccaggggcctcttcaagcactgtttgctggcaaagcaagaacctagtctttggggctctgtgggacattgagatttagtaacagacttcacatgcaggtataagttccagttctgtcatgtaactagctgtgtgaccttggacaggctgggttactttcttgaggcttagtttctttcactaaaaaatgtggcaagctctccttgccttacagtgtattgtaaatcttggcgataatgtgagcacagtgactgacaccagcaaattccctttccagggagggagagttctcctgcccatcactgagccaggatga

SEQ ID NO: 385336 - DNA, 263 bp, Homo sapiens
tttataatttccaggcttctcacacagtcagggagcgcagtgggagcgcaggccacagttgaagtaaccactggccatcgctgagctcagctcagaatccacagcctggaatctagctcccaacccagatgccagggcatatgccatctggatcccatctgaatccacagcctaaactccagggatagctgaagccagaaggtagaaggaggggtctcagggagagtgagcccccagggctgggggtctggcagaaacggggt

SEQ ID NO: 385337 - DNA, 375 bp, Homo sapiens
tgggttagagttaatggatttcatgttaattgtcccttaaatattttctaccattaacacatttcttattggaaatgatgtgtaagcaacagaaaatattccatttccttggataaaagatacagtaattactgtgtgcatagggaaaaattcggcagtttcagggtgagatttaacatttaagtatatgcaatcttatttatatacaagaacaagagcctgtggttaaaacacaatagggttcttttttaataaaccatatggaaactcatatatcttgtgagaggttgtgaattagcagagtacactaaaatatgttcgaatttctaaagcattcttattgtgcattgtctgtgttctaggtaaaaggaaaaa

SEQ ID NO: 385338 - DNA, 385 bp, Homo sapiens
  misc_feature (366)..(366): n is a, c, g, or t
actagaataggaataaaatgattaaacaatatgtatttaatttgctagccaatgtcatttaatggtgaaaagctaggaatactgcttgtaaagccagggctagaaataatgcctgctcacaactactacttaacattgttctgaggtctagccttgtaagtaattagaaagaactaaaattaatgaagaaatatagatattaaaaagacagtcacaaaaattactataggaatataattgcatacctggaaaacagaagcagcttttttaaaaagctaaagtgtactatttcagtaaggtgtccactgataaaaattatataaaaaggccaggcacagtggctcaagttaatcccagcactttggnaggctgaggcaggcggatc

SEQ ID NO: 385339 - DNA, 198 bp, Homo sapiens
gcctggcccatgtctatgtaactttaaaaaatacggtattttagtgatagagctggtggcagctgatgtagtagtagtagtccttttcatattacccttgatggtccacttcaaatgaatgaactttaatgattttactttaatagttcttactactttatgaattattttgttttgttttcataactccaacaaggc

SEQ ID NO: 385340 - DNA, 319 bp, Homo sapiens
gatcctaggcccccacttcctaagccatataaagaacataaggaggcaaagccgagaaacccaaaaatagagagaagagacagaatcaatgcttcaattgtgagaaagtaggccacttcaagaggtattgtcccaaattaaaatcagaaagagaagtcgtcccacttacgacctttgaggaggaataggggggttaggggctctgtctcttttaccttgaatcccaccaagagcccttgataaatttagaagtggaacccaaatctgagcttatgacctttttagtagactcaggagcagcctgctcctctgtttgtta

SEQ ID NO: 385341 - DNA, 358 bp, Homo sapiens
gagaatttgtgttggtttctgtcagccatctgagaacaattccaatccaggatcactttacatttaattctttgcctcacattttgtagatcacaaagacagagttaattaggttccataactatctaggggtcaactgatgtaattatgaagcatcaggatgaaattctgtgatcccttcctcccacctcggcctttagcacaaatgggaaaataagcatatcttcttgccgtaattgctctgcaaagagggctaatttcttattcaccattacatttatggtctaactctttgaggttccatatttgcatggggaacttctctctgaatcttcaccttgggaggccctaggcctat

SEQ ID NO: 385342 - DNA, 463 bp, Homo sapiens
gtgtgaagtggtgctgctggcatctaattggtagaagccacgatgttcacaaacgttgtatgatacacaggtcagccctgcacagcaaaggattatctggcccaaagcgtcaatagcgctgaggttgagaaaccctggtctaggttaaggagggccaaaaatgtagatccaagaaattagaactttaattgtatatgcattaacgaagccattgaggtttttttgttttgttaaggagggagtggctgtgtgcagtagaagtaggccagagatgtctatctataaaataaatttgattttataaattccttcgcaaaaataaaactcgaaaatgttaccttgtacaagaaggaaattacaaaatcagtttgttttttttcaggagcatctctaagagaagaggtgaggcatttggaagatactgaatgaaaccttgtaggcaaatatggctgggcactgtggc

SEQ ID NO: 385343 - DNA, 643 bp, Homo sapiens
aataaaagacatgttttgagaatggagcatttcagtgggaaaacgcatgccatagtaaactatgtgtgtattcaggaagacgaaggaagacaaagagttttaaaggaaaaaaaaatgaggatggttacacattgttttgaactaattatcttagctacaaaggtcaataacaagggtgacgtcagttaaaggttggacaggcagtttctgggcagacatccttgcagaggttttgtataaggtcgtgatggtctttgtgcaacgttgtggtttttacagtctttgttttcaggcatacaagcatgagtaccctctcttcatagcctttcctggctctatttgtcagagtttttgtttgtttgttacccaaatgcagtaagtcagtactgattggattttggctcaagtgaaaacatctacttacaaaaatggcaagaacaactgaagacaatttttgtaagcaatgttgtattctacattcattttgctttggttttaattttttttaattgacaaataataactgtcatattcattgggtacatagtgatatttctatacatatggaatgtagtgatcaggttagggtaactagcatatccattatccaactgaggacatctagtatggcccaggtattaaa

SEQ ID NO: 385344 - DNA, 459 bp, Homo sapiens
agaatagaagttgggacaaattagggggctatttcagttaaaaatggggagatgaagaccaatcaaggtatgtttcaaaaggaaataatgtattgacttattttatatatcccatattgctaattaaaggtcttaattaacagcaaacttttacagagcctaaaagtatgttgaggttaactatacataccttatgtttttccccaaagagggaaagtttaaaaatttagggtaattaattaccttcattagttttcattgctggagcataggttaataataaacattttaaaagaatgtcattttgcagatactgaattcaagtgaacatagagactcaaatctgatactaatccagcatttgtagcccttcaattctaattgctcaggattttgaaaaattaaaaataatctggaaaagtcagtgctttagcacatattctttgctctgaaaaaatg

SEQ ID NO: 385345 - DNA, 672 bp, Homo sapiens
gcagggaaacctgttttttgtagtgctgtgtacactaaatgaactgaggggcaatccgggagaaaaaaagcaagatgcagggataagatgcgtgtactgattttttacagcaattccagaaagttccctaagaatcatattgcagttattcaaaggcattttggcagaaggaacaatccctatctcggaggtaaaagtatagtttataatttttctcaagtacaacacactggcaaaaattctttggttgaattaggtttctgaattttctgctaggcccatctgtgcacttccctgtaaaatccagttttagcacagaccctggctaagtcagtttaccaagaaccaccaccaccaccccgccttatgtggttattctcaatatctgatcaggttccttattctccactatcccccagatgatgtctgattaccttggcctgtctccagcaagaatcctgttaggtatatttagccagaaactcctttaccccgatgtttcctcttagtaattttccatccactgacccctacacagctccttggccataaatgcccacttgcccatgctgctgtttggagttgagcctaatctctcttccactgcaaaaccccgttgcagtgagctctatatacctatcatgaagttcctgaataaagtcttccttacca

SEQ ID NO: 385346 - DNA, 613 bp, Homo sapiens
tagagacagggtttcaccatgttagccaggatggcctcgaactcctgacctcatgactcaccacctcggcctcccagagtgctgggattacaggcatgagccaccacgcctggtctgtgtgtgcttgtgaattcttaaaggatgtgtgtaagggagtgatctaggggcactgcacccagtgggaactcgggagagtggccagttgtctgcaccactctcgctctaggccataaatgaaagtatgtgccctgttagaattgctttcttcctcctgctttcaggatgtttgcaggtgtcggggagggcagactatttttacactgttcctctgcgtttatccattaaagtaggagagatgctcccagtgaggctcaggcccttgtcagacagagtccctggacggtagcagagcctttccatggccaatgacttatcagagcttttttccttccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggt

SEQ ID NO: 385347 - DNA, 254 bp, Homo sapiens
ggtattaactggtataacaagattcacctgagctctaaagatgtgcaagttattccataaataaaagactctgcaagaatactcagctggtgcttggagaatgagcttgaactttctgcaggatgttacagaccttggatcatcctagcctgaagatgtgtacataatttctcagtaactcctggtggctttgcccaaactccatgaaggcagaattggctgacactgctgaggagtgacacttcatggtacat

SEQ ID NO: 385348 - DNA, 1955 bp, Homo sapiens
  misc_feature (471)..(471): n is a, c, g, or t
  misc_feature (680)..(680): n is a, c, g, or t
  misc_feature (1590)..(1590): n is a, c, g, or t
gaggcaaatatttattttcattactgcccaacagttttctaaagtgttgtactcttttaccctcccaccagcaatacgtagtaggtacagttgttctacattctcaccaacacttagtattttcagtctttttcattttggtcattctggtgaatgtgtagtggtatactactgtggttttaatttacatttccccgatgagtaggaatattgcttaccttttgatgtgtttattgaacatttggatatcttctttgtgttatgaccattcagacatttgttcagtttttattttacttattgatttctgagggctctttgtatattctagacatgagtattttgttagacatgtgtattataaagtgaatattttgttctaaacagtgtcttgaatttttactttatgtttactttgaatatgttggtaatcctagggacctgtgaaatatgagggaagtgtgcagcagngagaggaaactgtaaggcaagaagtggacccaccttaataaggggaaaacaagaatgacatttaacctgcagagcaatttcacttggagacaaggacagctggtcccttgaatattggatggtggcaaataagacatccaagcactaagagggcaggcagagaagagttgagaatgaagcaacagcatgcttatggtggctgatggccnggtagtgagtagacaagagtggggctctggacatagatggtctgaatttgagtcctgtctcccacctactaccatcttgtgaaggtacttaaccactccaagttcctaattttaaaaaagcaaaagtaggaataatgcgagcacctacttcatgggtttgttctaatggtatactacctatccccatttttcacatattgtgaatacttaatatataacatcaaaaactacaactcctatgctgggaaaatattagaacaaataatgtttgttgttgttaatatttgtttacttattggaattggcttcagagatactctacaaataactcttggggtagagatggatgttctagcagatttgggagtcaatcagaaattggctcctgtttcagaaagttacagttattatggacttgtgacatttctgttcagaagtctgtatctggcatcttcccgcacacatgtcttgctttcaagtgctgttcagttatgtttggaatgagaatggtggtctccctacttctgcttcacttcttccacaaccttgctgacttctaaatagtttcctgcttagaatccttaggaggaattaggatctcctttcagccctatcttgggcactgacttacattcccacatgtggtccatgtgcccctagacaatctaaggagagtctagcttgccacacatgtggaaatcattcccagttcacaggtgggaagttatgggaatgaagaaaatgtgggggaggtagcaataaaactctctacttacatttcattgctgcatctgctataataaaatgagagccaagagcaacttattcccttgtgacatgatgacacacctctggatagatgtatattcagggatatgggtgggtggagaatgttacaaacactttctcntccctagtatcctattacctgtctgaagaagtacactgtgtaccttcgtatcactatgtcctataaaaaaagaaaatgaaaagaatgtaaaagaagacatggtcacttttggggataaatttaactacccaacagagagagaagaattactttattcatataagggttcattttacaaggatcttccagaaatatttccttgatttgtgtgctattcacagagggactggtcacagatgccagttagacattggattctttgactaaccactcttcatcttgtgctcttgagtacaaacagtacgttagagagaacattaaaaaaaagattgttttcagcaatttattcctgaatcaaaatccaa

SEQ ID NO: 385349 - DNA, 803 bp, Homo sapiens
ctggagcagggcaggaggaagaacagattccatagtgatggttattctgacctgtgatctttgttgaactgaactgctttctctagacaccattgttaccaaaggaaataacacgttctcagtctaccttactgcttatcggttgtgtgggtcacaggaattgggggtgagggactgctttaaaggatcaggatcagggtgaacaaaaactactgaggcttcagtgtcagttatcccaaagcccacatcgattgtgtgattctgtaaatcctaaactaaataggagcaaccgtctctgatatttattttgtgcgactgtcaacctcaaatgccatcctgaattctgtatatgacagtcaccagcctgcctgatacctcgttgatcgacttttccccatgctaccaagccatgccaggtggacagaacaattctccagggaagccaagagctatcacttcctttttctacctaatatattttgtccctgataatccatttgtcatatctgactttctccttcctgctggcagcaaccagagaccctctcattacacgactgccaggtttgcttcagcctgaactgctgcagaattaacttgtcatgtccgctccaccatgggaacctgtggggagtcagagcctcaaacagctgaaacaccggagggaaagatttcctgcctgtctcacttccatctacagcaccatggtgcactcattaaggcgtgggttggaaggtgctatagacagatacgcgcactgggaggatggaacctgcttttgaacttaaaaccatgaagacacg

SEQ ID NO: 385350 - DNA, 773 bp, Homo sapiens
ggtggcctttcctggatttgcacagtgtgacctgagcgtgtggataactgtggccagttgagtggggggttgtcagtgcctgtgtgtggtggcaggagggctgcctgattgtcagggctcagatcccagaagaagcctggctctcagattcagggcctgtctctggggttcctcggcggtgtggtatttctgtctgagccagctcctgggaactgcttttccttcctccaggaccctagggagggggctgtgctcaccctgggaacactgccatggtcaggatcttgattcctgggtagctgctgagggcccctccccccacctctgactcactgtctgacacttttcttagattctcactatgtttcattccctcttggcctctccttgtctctggctcagtctttttgtttcatctcctgcctctgcctcttagcctctggattccgaggtggaacagaggaacatgagaaccaggggcacttcccccgcctctccagaggagtatcagggaggaggtaatttctcatttcattcccgctctgcagatttggaggggattgttcatcactagaacctgcagcatgaccgtagcttccctgtgtctctgtttccctgtctgtaggcttggaggtcataacctcctcaccttaagttctctttctgtggcgatcccttaggcagagccgcagtgcgtatctgagcctgctttcctgacatctctctccatctgtttcctcttgggggaccagggagcctcctgggattgccta

SEQ ID NO: 385351 - DNA, 460 bp, Homo sapiens
tgaattttacctttcatctttatatagtgcaatgctagaggtttttaataaaatttaccatcttaaccatttttaagggtacagttcagtaacattaagtgtattcacactgttgtgatgaacgtcagttttaaagcaaatgtaagagcctttagctggtatgtagaatcactgaaatgacataactcgtatttcatagcttatacatgcatgtgtattgcattgtcaatagaatggtgaaacacaacacaaaactaactcagcggtttgtatctcatttctttacacatggacattgtccccacacccttgacttttggcttactgatgagtaaggaaggactaaaaggaagggtactacaggttgcctgatctttttctttctatgtcatctttggtgtaagtggttgactaacagagatataacacacttgttaagaaaggaacggatagggctccc

SEQ ID NO: 385352 - DNA, 327 bp, Homo sapiens
tgctgggattataggcgtgagccactgcacccagctgctttcctcttacaactttttaaagctgtattctttctttcacaattcataattgagtgaaaggaaaaagatttgatttttttttcctcacaaatataaggcatataatattcttagaaaatttcaagccttactattgagataacccttacaaatttaaacatttttagctgctttattggctttaaatgattaagttcataattgcaagtcatctggtttctaaactgctagccttattagttccaaagtattgttgatgcttttgtttcaatatccccccaaaaaaca

SEQ ID NO: 385353 - DNA, 278 bp, Homo sapiens
tggtaaatagtgttggtaaatgtcagtgtcggtaaatgtcagtgttggtagatgccagtgtcagtagatgtcagtgttggtaaacagtgttggtaaatgtcagtgtcggtaaatgtcggtgtcggtcaatgtcggtgtttgtaaatgttggtgtcagtagatgctggtgtcagtaagtgctggaggactgagcatgccagcggcaagcccagtgaccagagtccctgggggctcccctgggacagggatgcccacttccaccctgtgcgggtttcacc

SEQ ID NO: 385354 - DNA, 317 bp, Homo sapiens
cttttttggtgattgctaagctctatttttcttatcctatatatatatgtggttggtttttattttaggattttaaggttatccctaataaattttgagatgtgttccatagctagcctgttgagatctttttatatcaaaagttaatatctgtggatttgtaatcattctttctacatatttaacaaagtcattagcaaaatattgaacaaaacctgttattcatatccttagatacagaacatcaatatcctgagatacagtacatcatcaaaatgtggtccccaaatgagcagcaatagcatcatgtgggagct

SEQ ID NO: 385355 - DNA, 174 bp, Homo sapiens
  misc_feature (170)..(171): n is a, c, g, or t
  misc_feature (173)..(173): n is a, c, g, or t
ggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactcnnant

SEQ ID NO: 385356 - DNA, 420 bp, Homo sapiens
tttactcttaaactatcctttactgggaatacatatttcctttcaattaccttgcttacagctaggttttgaaaaaaaataataaatgacttggagcagtttttaattctttaaaaaaatccatgttcatgaatctagtagtaagttagaaagactaaaatgggccttacagcataggacttgagagtttctgtttatgtaacaaaacatgttcatcgtagcgtctgtagctgtggtgattttcaaaagatagtaaaatgccgaagtctgtagcagaactggcgtgtgcccgagcattctccactgaatgccagagattgacttcctcattgctattcactgtggatccagggctttgcagggttgttcagtgggctgaggagtgaaacattccgctgtgctggctgatgttgcacttgg

SEQ ID NO: 385357 - DNA, 744 bp, Homo sapiens
gccctctgaagcagagactggttggagtgcccgtatttctgtagaccggaggcgtgtaactagaaagagtttgctaaccaagtgggccagagagagccttgaaattagcatctgaaaaccccagctttggcctgaaggcctcccgtgcagtctggtgaatggatgcttgaaaacaatttgttttcctaattacgtaaatctagtgaagagtatttatctttttttttttttttttttttttttttttttgcttacctggggaaagtctaaaatctctggtctcaagccggaggagcgtatattaattctcttctccagccccaccctatgacttaccagagtgggtacctgggagaacagggagatggggtagggagactggcaggttgtctttattgaagtttcctgggcaatgccaccaggtctgtccccctctggtataaacctctgctcaattccagtccaaattctggctcaacctaccaaagtggttttgctgaactcagctcctggggctggccacatggtaccaacacatataggatatctcaaaaatgaatttggaagtcccaaacatgcgggtctttggtggctcagaaagcactaaggatcagattagaatagtgaactgccattgcacagaatggggaagggtttgtgttctggttatttcagatagtggctctttggattctggataatggaggtccaagtgctgacattgttaaaaaccagattaacagt

SEQ ID NO: 385358 - DNA, 228 bp, Homo sapiens
tgccagcaggtaggagctacccactccaggtctcctctctgctgagggctacagagaagtcaggatgacctgcctgtggatagaagctacctactccaggtctcctctctgtcgagggctgcaggctccactggatgacctgcctgtggaaaagagctacccacttcaggtctcctgagagctgttccatcactcaataaagcatctctgcaccttgcccaccctcca

SEQ ID NO: 385359 - DNA, 472 bp, Homo sapiens
  misc_feature (137)..(137): n is a, c, g, or t
  misc_feature (254)..(254): n is a, c, g, or t
  misc_feature (365)..(365): n is a, c, g, or t
cgtctgtcaccccctgcactatacggtcatcatgaacccccagctctgtggactgctggttctggggtcctggtgcatcagtgtcatgggttccctgctcgagaccttgactgttttgaggctgtccttctgcaccnaaatggaaattccacactttttttgtgatctacttgaagtcctgaagctcgcctgttctgacaccttcattaataacgtggtgatatactttgcaactggcgtcctgggtgtgattnccttcactggaatatttttctcttactataaaattgttttctctatactgaggatttcctcagctgggagaaagcacaaagcgttttccacctgtggttcccacctctcantggtcaccttgttctatggcacgggctttggggtctatctcagttctgcagccacaccatcttctaggacaagtctggtggcctcagtgatgtacaccatggtcacc

SEQ ID NO: 385360 - DNA, 306 bp, Homo sapiens
gaagaacaggtgccaatgaaccttcccatcctcgtctctgaaaaatcccccaacttccctgacagtcgggccagatatcccccgggtcccctagacaagcactcagcttttccggccttctgatccctttaactgaaatgctttctgcctctaactgtacctactaacatcacatatactctttaaagttcaattcaaatgttatttctttcaagaagccttgtctaataataccccagctcctagaaagaaaattcgcttgtctgcatccaacgcattcagtcctttagcaatatgatcctgttc

SEQ ID NO: 385361 - DNA, 385 bp, Homo sapiens
tgccaaaaagttgagtgggaaaataattccatcctttcagagctaaacactgtgctgagtctcatcgcacacgggtgggcaaagaaagttgacatttactgctcacccactctgtgccttgacctgtgcaagatgctttatgctagaactcatttaattctcaagaacaacctcattttacagataaggatacagaggctctaagagttaaatttacccaagaggacatggtaagtaagtgccagtgcagggaacaaattcaggtccgactctaaaatctgtctctttccagatctcaaggcacaccactgagttgcctttcacctttctcccaagatgaggattgctctggcatgacttcacctttctcttctgaagcaattcc

SEQ ID NO: 385362 - DNA, 439 bp, Homo sapiens
atgtttccttcttttacttattttaagatttatttccaactgtaagcttaactaacagatctattaatacatactttaattttagaggcttaaaacattcaattctctgaatctaaagcaaaaaggagaaagtgcaaaattacaaacatcaagtaaaaatagagaaggatattttgaagtcagtttcctctgcagttgtccctccccgtcagaccagccctgctctccctgtgtctcttcccacacatgtactgccccttctctgtgtatgaagaatgagactctcctgttgcagaccaatgcagtacccaattcagtacctccagaggagaccactatcacgtccctgaagcacagggcactggtcacaaaggtgggtccagaccatcacctcagaggcttagcattctctggaatccagaatggagttgaacaagca

SEQ ID NO: 385363 - DNA, 411 bp, Homo sapiens
tactcttttcagtttctctcatcagcattttattgttttatttctagggatattttacctccttggttaaatttatgcctagatattttttgtagctcttataaatgggattgccttcttaatttctttctgaactagttcattattggtatatagaaatgctactcaatcttgtttgatgatttttgtatcctgtaagtttactgactttatttatcaggtctcagagttttatggtggagtcattaggtttttctagagataaaattatatcatctgcaaagaggtgcaatttaactttcttcttttcaattcagatgccttttatttctatctcttgaatgattgttttggttaggacttctagtactttgtggaataggagtggtgaaagccggcacctctgtttta

SEQ ID NO: 385364 - DNA, 447 bp, Homo sapiens
taaaattacattaaaatgccagatataaaatttataattcactatttttaaataatccagaatagcactgaaaataagaatgacagcttttaggagatcatatattttaagtaatttataaaatatagaaaaacagaaggtgtcatattgattaatgaactggagcaagggaaaactcaaagcagccacaggaaaggggttccataaggaagcagatatttcttctcactcccacacttgaaatcaatagagtagatgctgctgtagtaatactagtaatacaggcttcttgagaaacagttggactagtgggacacctacctttctgccatctatctacctattaggccggctatgagatgttttccccaataaatactattgatacagttgtctatcaagtacatatttaggggtgagaaggaaagctctggtatgacaccatct

SEQ ID NO: 385365 - DNA, 177 bp, Homo sapiens
cggacagagcagggcagaaaaatgagggaaggatgacagaagctcatcagaaagccagtaatacataagattagttttgtcagcaaaacctagtaaactttgacgttaaaagacaaatattttgatctctcattcccactctcaaaaaggtttctagttcatattgttttgctaaaa

SEQ ID NO: 385366 - DNA, 788 bp, Homo sapiens
  misc_feature (1)..(1): n is a, c, g, or t
ncccatctctactgaaaatacaaaaaattagccaggcgtggtggcgggcacctgtagtcccagctactcgggaggctgaggcaggagcatggggtgaactcaggaggtggagcttgcagtgagccgcgatcacgccactgcactccagcctgggcgacagagcaagactccgtcttaaaaaaataaaaattaaaaaaaaaagtaaacaacatagagaactcaaaagttcctttgtctacctccaccaccccccaccaaaaaaaaaggcccttaactacatttgactttaaggaataaacataagagaactcagaattcctttgtctctccccacccaaaaaaaaagaaaaggttcttaacttttcttgacctaatattcagcactgaagtcttattacttgaaacttatcagatgctaaattacaccattcatacttattgttctttcaatagcaaaatgtactgaaagctctccagtcccccctccactcctggcaagcatgcagtcacgtgctcgtgtgaattttccaaaatcatgagcattttgtaagattcagttggttatatgaaattacaataaagagtattatatattttattataatttgtaaattgtgtgctatacattctttatatcagtaaaatttatagtaaacacatatacattatatactcacacacacatattactggtctttctagaaacttgattttgtgaaattctagaatgaattcccagggtgatatttgtttggcctatgaataaattgcaatgaactaacaggtaa

SEQ ID NO: 385367 - DNA, 772 bp, Homo sapiens
  misc_feature (755)..(755): n is a, c, g, or t
cggctggaaattaacccccactaaaagggaccaaaagctgaagctcaccccgggtggcggccgctctagactagttggatcccccgggctgcagtaattcggcacgaggcgctaggacctggagggctagtcggcgggctgcgcgtccggccgctagctgagctggaggccaccggccagagccgaccccaggagtgagagagacaggggcgtgcgtgagttccggcggcctgcaccgggcaaaccccgtaccttcccagcatcggctcagcaacccacgtgcatccaggccggtcaatgtcattgagtcacctccgcgccttggccaccctggagtcccgagaatccgaagttccagacaaatgcccaaactacattcctgcatgttcgaaagcgtaaattgcaaagcacaaatccagttgtagattgtggccgggagcagtggctcacgcctataatcccagcactttgggaggccgaggcggacagatcacgaggtcagcacttcgagaccagcatggccaacatggtgaagccccatctctactaaaaatacaaacattagccaggcatggtggtaggcccctgtaatcccagctactcggtaggctgaggcaggagaatcacttgaacccgggaggcagaggtttcagtgagctgagactgcaccattgcactccagcctgggcgacagaccaagactccatctaaactggaacctcgtacactatgctgagtccttccagtggatacanagccacgatgctcactg

SEQ ID NO: 385368 - DNA, 1027 bp, Homo sapiens
atccgggatccggcacgaggcgctaggacctggagggctagtcggcgggctgcgcgtccggccgctagctgagctggaggccaccggccagagccgaccccaggagtgagagagacaggggcgtgcgtgagttccggcggcctgcaccgggcaaaccccgtaccttcccagcatcggctcagcaacccacgtgcatccaggccggtcaatgtcattgagtcacctccgcgccttggccaccctggagtcccgagaatccgaagttccagacaaatgcccaaactacattcctgcatgttcgaaagcgtaaattgcaaagcacaaatccagttgtagattgtggccgggagcagtggctcacgcctataatcccagcactttgggaggccgaggcggacagatcacgaggtcagcacttcgagaccagcatggccaacatggtgaagccccatctctactaaaaatacaaacattagccaggcatggtggtaggcccctgtaatcccagctactcggtaggctgaggcaggagaatcacttgaacccgggaggcagaggtttcagtgagctgagactgcaccattgcactccagcctgggcgacagaccaagactccatctcaaaaaaaaaaaaaaaaaagttatagattgtaaggaaaatacccccaaggaagttgaggacacagcagacttggactgtctccaaacctgttcattcttctgagtgcactgctcggagcatcctattgggcagcatatcctggcctcctttccagttcgatgtggtactatacctgatttctggccaataaaatatgagaggacatgaaattcaacagcccctgggcttggcttataaaaccttccatgcaatcctccacaccttttcacctctcagctgctgagacttttctaggcactacacagaagcagcctgggtctccagtagcaaaggagagcagatccttctcactatcctgcaccgaactgtgacatgagcaaaaaataaagtttttattttcttacac

SEQ ID NO: 385369 - DNA, 1116 bp, Homo sapiens
cggctggaaattaacccccactaaaagggaccaaaagctgaagctcaccccgggtggcggccgctctagactagttggatcccccgggctgcagtaattcggcacgaggcgctaggacctggagggctagtcggcgggctgcgcgtccggccgctagctgagctggaggccaccggccagagccgaccccaggagtgagagagacaggggcgtgcgtgagttccggcggcctgcaccgggcaaaccccgtaccttcccagcatcggctcagcaacccacgtgcatccaggccggtcaatgtcattgagtcacctccgcgccttggccaccctggagtcccgagaatccgaagttccagacaaatgcccaaactacattcctgcatgttcgaaagcgtaaattgcaaagcacaaatccagttgtagattgtggccgggagcagtggctcacgcctataatcccagcactttgggaggccgaggcggacagatcacgaggtcagcacttcgagaccagcatggccaacatggtgaagccccatctctactaaaaatacaaacattagccaggcatggtggtaggcccctgtaatcccagctactcggtaggctgaggcaggagaatcacttgaacccgggaggcagaggtttcagtgagctgagactgcaccattgcactccagcctgggcgacagaccaagactccatctcaaaaaaaaaaaaaaaaaagttatagattgtaaggaaaatacccccaaggaagttgaggacacagcagacttggactgtctccaaacctgttcattcttctgagtgcactgctcggagcatcctattgggcagcatatcctggcctcctttccagttcgatgtggtactatacctgatttctggccaataaaatatgagaggacatgaaattcaacagcccctgggcttggcttataaaaccttccatgcaatcctccacaccttttcacctctcagctgctgagacttttctaggcactacacagaagcagcctgggtctccagtagcaaaggagagcagatccttctcactatcctgcaccgaactgtgacatgagcaaaaaataaagtttttattttcttacac

SEQ ID NO: 385370 - DNA, 421 bp, Homo sapiens
caacacacattagccttaacaacaaagagctaatcttatgtaaagaactcttacaattcagaaagaaaaagatcctagtgaaaatgtgggcaagagatagcaaaaaaccagccatatgataataatagtcaataagtgaatctgaatgatgttatcttcttttgtcattttagaaatacaaataaaaatgatgatgaatgctcttgcttactaaattagcaaaaactgggaaaagatgatgatattcagggtcagataaagggaaaagggtgcccttctattgcagtttggaaagtaaattggcactgactttttagtgggatagtcttgtaatatgggtcaaaagtcttcaatcgtgtccacattttgggcctgcaattccacttctaggaatttattctaaggaagtaactaaaaatat

SEQ ID NO: 385371 - DNA, 370 bp, Homo sapiens
gattacaggtgtgagccactgcgcccggccgagatttacttttataatgacttctaatatttagcattcaaaattgtgaaaggggagaaagatgtctgagaaatacagaatctaagattgggatttgtctaagtaattctttcatatttcataagttgtagtccttaaataaaaaggtttcatgtggttattaccaggaacatcaagcctcttgttcattctgtctggattaatatagattctcaaatatatttatttattaggctgtgctttactcttgttgataagacatcagaatgacttaatactttaagtctgttatttcctttcctgtttaattgcacacagtccccccaaatcacacccttct

SEQ ID NO: 385372 - DNA, 1809 bp, Homo sapiens
ccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattgtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatagctacaacatcatttaacttttataaacatgccttctctctattgaagacatctgatatttttgctggaaagttggatctatcctcagtaactctgccatgaattcctgtttcctggttccagaaaaagaaaagattacatttctgatcataaagaatgtcttgcatatgggaaatttttcaaaataaggggggtattatttatgtggcatgggaaaacttttgccatggctgtttgtcttagtggcatcttttgatgacattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttaacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggc

SEQ ID NO: 385373 - DNA, 214 bp, Homo sapiens
aaaggaagcaagctttattgaatttacaacgtagaaaatatttgtagttccttagacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggc

SEQ ID NO: 385374 - DNA, 353 bp, Homo sapiens
acctctggggctctgagtttcctcaaaagagtagactgcttgttttctgaggcaaagccattcagtgattggcatgacaggttttcagcaatgcccttatcactctgtataataactgctactttatctgccccccatctctaccctgcataattcctcaagggtagggattgcatctcttggcccctagcccagggcctaacacaaagtaatgttccctaactatttctgaattagggtgtcattgtgggtaccaagtggacacttactaaatgcttgctaacctaaaagttttcttattgaaaaaaaaattttttggctgggcatggtggctcacgcctgtaatcccagca

SEQ ID NO: 385375 - DNA, 1999 bp, Homo sapiens
  misc_feature (587)..(587): n is a, c, g, or t
  misc_feature (612)..(612): n is a, c, g, or t
gagacttttaatcatctatcccttgtgctttacgcagaccctacaatacactagaggcttcaaagaggtcaaaaattcacatgtgtagacaaattaggtcccttaagatgccaggcaaacgaagtgctaccaaaacacgcaatgactgtcctaaaagtgcgttctgggatacacctgtaaacttggatcaagttccctcccctctcctcaaaatatatcgacttgtgctgaaagaaatcacgaccgatgctcacaattctgacctcgtaattatatagggggtggttttggtttctgcgtctttccctgattcagtggcaggtaacatatttcatgtacaaaatgaactgcaacaccacggcaaacaagggacaggccctcaaagttgtcggtagggagccaggaccccgccagtggcgtggggagacaccgtactaaacaagcttgcaaacagcaggcaccttcctgccactgaggaggaagggctggctaagggaggccggggcggaggaagccaagctctgcaggccctgacaaagtcctcccggcctccacgcgtcgccatggcaacgcggggtctgtgctgnccgggattggccggcctggcgcgcncagggcccgctgggaaagcgcgtccccgccgcggctccgccagtttgaacttggcgggccagatgtgggcggcggggcgctgggggcctacttttccctcttcctacgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385376 - DNA, 1481 bp, Homo sapiens
ttgtgggtgattagcaggatccctcgaatcgacggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagagaattaaatcaacaactagaaaaaagaagaacgtgaccggctgcaactgaaagctctaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385377 - DNA, 1199 bp, Homo sapiens
aattgcccctatgatccagttacctcccaccaggtccctcaaagatgatatttgggtggagacacagccaaaccatatcaaacacctgcttttcactcagtactgccccaggctctgagtggacattggtgagcaagatctttgtcactgacctcatgaaacttatagcccagcaggtagactgacattgtactgttaattgcaggtatgttatatattttcataaaccatgttgtgccaactgccatgatatcatgtctatttttaaaaataattgaagtttagaaaattgctgaatgcagcagtctttccttagatgagtataattactggtattacaattaaactttatctatttttatttaagaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385378 - DNA, 2742 bp, Homo sapiens
  misc_feature (587)..(587): n is a, c, g, or t
  misc_feature (612)..(612): n is a, c, g, or t
  misc_feature (2741)..(2741): n is a, c, g, or t
gagacttttaatcatctatcccttgtgctttacgcagaccctacaatacactagaggcttcaaagaggtcaaaaattcacatgtgtagacaaattaggtcccttaagatgccaggcaaacgaagtgctaccaaaacacgcaatgactgtcctaaaagtgcgttctgggatacacctgtaaacttggatcaagttccctcccctctcctcaaaatatatcgacttgtgctgaaagaaatcacgaccgatgctcacaattctgacctcgtaattatatagggggtggttttggtttctgcgtctttccctgattcagtggcaggtaacatatttcatgtacaaaatgaactgcaacaccacggcaaacaagggacaggccctcaaagttgtcggtagggagccaggaccccgccagtggcgtggggagacaccgtactaaacaagcttgcaaacagcaggcaccttcctgccactgaggaggaagggctggctaagggaggccggggcggaggaagccaagctctgcaggccctgacaaagtcctcccggcctccacgcgtcgccatggcaacgcggggtctgtgctgnccgggattggccggcctggcgcgcncagggcccgctgggaaagcgcgtccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaagtaaggaggggaaaatggatacacacattgacatctcttttgcaaaatatttcttcctattatacttcattacctaggttttaaaaaatacttctcttagagtctttcttctttggcttgttttgtttttctatcctggtggacatttatcaagtctctatcttctgccctttgccctctacttttctcctttttccctcctgtggcttgcactaatatttgcctgcaggcagtcaccaagtctgtatttctaggcctgaccttttggatccttatggcaagtgcctccaagtctgcaaatctaaaacaacccattttgcccatttctccttcgtaaatccatcctcccatttctctgtttcattcagctgtcttctcggtcatcaaggcttaattagaattcttctgttgttcctaatcatctcctccttttctttacaattactactcccctgtttgtgatctctttccattatatctttcaacttgttgtttacttcttatactggattgtaagctacataagggcagggatttttgcctcttttgttcagttttccaggagctagatgaatacctgcgcatgatatatgtccaaaaatagtttaattgagtgaagatgttcattgaatggctgcattttttccttttaattttaatatattcttctatggatcacacacattcgaaattttaaaaatacttattctgtggtcaatttgtcttctgttgtgatttttacatatttagagtggtactgcttttattattataatccagttttacaaatgtggaaaaatgtttaaattgtaggacaatattttaaattttaattctaactttttatctttattgttgaatctaatgcctaatggtattaataagagtactaagtaaataatttcagtaaattgaagatgatataaccttcttcatccaagtattataagaaggaaattggttagatgtatgtgtgttataaccatatttgtttagaagtcaattactttgtttttttaaaaaagtttacttcatcccatgatataacatgaaagagatctttgtgaataaattcaaaaatcaaaataaatctctgtgactgttataaaactttgggtaatatctttttgaaatttgtaactataaaacaaaattattttacacatgcagaatagtttgctctttcctctaaaagtccttcttatcttctaactccattaagctaattttaccatgccaatcaaacctagttgttgtttgtctaggaatgtaagatacttctgggagacaatatattcactgttttaattagtggcagtagacctaatccaattatttgaagaaaaaaaaaattatttcttttggagggaagtggcttgccctgacataaatcactagttattgaaggcaaaattccgtaatgttgagaattatttaaaaataaaactgagacgttatatnt

SEQ ID NO: 385379 - DNA, 2112 bp, Homo sapiens
  misc_feature (587)..(587): n is a, c, g, or t
  misc_feature (612)..(612): n is a, c, g, or t
gagacttttaatcatctatcccttgtgctttacgcagaccctacaatacactagaggcttcaaagaggtcaaaaattcacatgtgtagacaaattaggtcccttaagatgccaggcaaacgaagtgctaccaaaacacgcaatgactgtcctaaaagtgcgttctgggatacacctgtaaacttggatcaagttccctcccctctcctcaaaatatatcgacttgtgctgaaagaaatcacgaccgatgctcacaattctgacctcgtaattatatagggggtggttttggtttctgcgtctttccctgattcagtggcaggtaacatatttcatgtacaaaatgaactgcaacaccacggcaaacaagggacaggccctcaaagttgtcggtagggagccaggaccccgccagtggcgtggggagacaccgtactaaacaagcttgcaaacagcaggcaccttcctgccactgaggaggaagggctggctaagggaggccggggcggaggaagccaagctctgcaggccctgacaaagtcctcccggcctccacgcgtcgccatggcaacgcggggtctgtgctgnccgggattggccggcctggcgcgcncagggcccgctgggaaagcgcgtccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385380 - DNA, 1423 bp, Homo sapiens
ttgtgggtgattagcaggatccctcgaatcgacggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385381 - DNA, 1237 bp, Homo sapiens
  misc_feature (35)..(35): n is a, c, g, or t
cctccccgtcaccgtcgtcctcgtcaaactggaanctctggtggccaaggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385382 - DNA, 1199 bp, Homo sapiens
gcaggggttcctagtgagtgaaatgtagagtctggatcagccgttggtgaaagaagaggctggaagataggcaaagggcagattcatgggtgtcaggctaaggagtttggattttatcctcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaacttttcaaggttgatcttggcatgttgttttgcagaataagtggctgaatatgtaagaattgtgtttgtatttagcttgtattaaaagtacactgtaataccaataaaactaacaatttttcttgaaaaaaaaa

SEQ ID NO: 385383 - DNA, 610 bp, Homo sapiens
cgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaaattttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgcttta

SEQ ID NO: 385384 - DNA, 330 bp, Homo sapiens
aggaaaaaacatggcccaggccctttccttccccctgtgctgacagcattgctgtgggggtggccccctgccctcccctggccctcatgtccccccgggggtggggtccccctgcctgtgctgtgcttgcgacgtgcatcaataaacccccatggcctgagggccctgctcgtcaaaaaaaaaaaaaaaaaaaaaaaaaattaaggatgttttctagttgtgcatgaatgctggcaacttagtaagttttgacaattgtttaaatatgtaatgttaagcttaggtttaaaaaagtaaagctggtaaactgggtctttgtcatttgcttta

SEQ ID NO: 385385 - DNA, 387 bp, Homo sapiens
catataaaatactctagatcccttatagtgtcccctgtaagtaactggtttagtttgctcctttattagcttctgtgacaatgttaatggtctcattttggcacggggtagaatattccatcggctgtgcccaggcatttattttcagacttgaagtcgccacctacatgtctggatctaagatcttggcttatcaactgtctctgtcagcagcacattcatgtccctattgagcttccccaaatatattggatatttgtaaaggcttcctgaacttctcaaggtattgctccaagatgtggatggacgactaaaacttcagcatctcaaatctccactctccccaaacctcttttttttcttctcccattccaccaaggctggaaa

SEQ ID NO: 385386 - DNA, 2734 bp, Homo sapiens
ggagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 385387 - DNA, 2545 bp, Homo sapiens
aagccctgggctgccagcctcaggcagctctccatccaagcagccgttgctgccacaggcgggccttacgctccaaggctacagcatgtgctaggcctcagcaggcaggagcatctctgcctcccaaagcatctacctcttagcccctcggagagatggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcccaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 385388 - DNA, 1315 bp, Homo sapiens
ggcggggtccggacggggatgccaagagcagggatgggagcgagcctgcgtccgggcactggtccccatcccgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 385389 - DNA, 1960 bp, Homo sapiens
ggagcaggaaatgccgagcggcgcctgagccccagggaagcaggctaggatgtgagagacacagtcacctgcagcctaattactcaaaagctgtccccaggtcacagaagggagaggacatttcccactgaatctgtctgaaggacactaagccccacagctcaacacaaccaggagagaaagcgctgaggacgccacccaagcgcccagcaatggccctgcctggagaacatccaggctcagtgaggaagggtccagaagggaatgcttgccgactcgttggagaacaatgaaaaggaggaaactgtgactgaacctcaaaccccaaaccagcccgaggagaaccacattctcccagggacccagggcgggccgtgacccctgcggcggagaagccttggatatttccacttcagaagcctactggggaaggctgaggggtcccagctccccacgctggctgctgtgcagatgctggacgacagagccaggatggaggccgccaagaaggagaaggtagagcagatcctggcagagttccagctgcaggaggaggacctgaagaaggtgatgagacggatgcagaaggagatggaccgcggcctgaggctggagacccatgaagaggccagtgtgaagatgctgcccacctacgtgcgctccaccccagaaggctcagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtaaggatgcccccctcccccacaacccaggccctgggccgctctggtgcagcggcagatgggagccgggccattgcagataatgggcttgtttttaaacaactctggggaaaagcaaactgacaatccgttcgtaagctccatcccttctgctcagtcatgacctgcccctgtgagagatgaagggttagtcccagttgtgatgtgataagcccagacctctttccttccgacaggtgatcgtgcatgcagaggaggctctgagacgcccccagcaaggttcctgggtttaacccaacattccccaaagtatgtatttggccacattcacagaaagaatattagtcttttgtggaatgctgcgggttgacagtcacagcttggaaaccaacccacagagagctcatcattaatcatggctatcacttgtttaccacctactgtgccaggcctatgctaattactttattagcgtcctctctgccgctcgcaggcctctattattataggtcagtagtattcgatttatttaaattaaatacggaggcctgctaacccacaggccgacctggtgcggctcgacgggctacctcgtttattcccacatacgcatgaccggctgtcgt

SEQ ID NO: 385390 - DNA, 2193 bp, Homo sapiens
ggcacgaggatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctaccttgatgacaggatctggcctcgtgccgaattcggcacgagtggagcgtgaagaccaaacaccagatgtactccatccccgaggacgccatgaccggcactgctgagatgctcttcgactacatctctgagtgcatctccgacttcctggacaagcatcagatgaaacacaagaagctgcccctgggcttcaccttctcctttcctgtgaggcacgaagacatcgataagggcatccttctcaactggaccaagggcttcaaggcctcaggagcagaagggaacaatgtcgtggggcttctgcgagacgctatcaaacggagaggggactttgaaatggatgtggtggcaatggtgaatgacacggtggccacgatgatctcctgctactacgaagaccatcagtgcgaggtcggcatgatcgtgggcacgggctgcaatgcctgctacatggaggagatgcagaatgtggagctggtggagggggacgagggccgcatgtgcgtcaataccgagtggggcgccttcggggactccggcgagctggacgagttcctgctggagtatgaccgcctggtggacgagagctctgcaaaccccggtcagcagctgtatgagaagctcataggtggcaagtacatgggcgagctggtgcggcttgtgctgctcaggctcgtggacgaaaacctgctcttccacggggaggcctccgagcagctgcgcacacgcggagccttcgagacgcgcttcgtgtcgcaggtggagagcgacacgggcgaccgcaagcagatctacaacatcctgagcacgctggggctgcgaccctcgaccaccgactgcgacatcgtgcgccgcgcctgcgagagcgtgtctacgcgcgctgcgcacatgtgctcggcggggctggcgggcgtcatcaaccgcatgcgcgagagccgcagcgaggacgtaatgcgcatcactgtgggcgtggatggctccgtgtacaagctgcaccccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgagagcagtggccgcaagcgcagggaggatgccacagccccacagcacccaggctccatggggaagtgctccccacacgtgctcgcagcctggcggggcaggaggcctggccttgtcaggacccaggccgcctgccataccgctggggaacagagcgggcctcttccctcagtttttcggtgggacagccccagggccctaacgggggtgcggcaggagcaggaacagagactctggaagccccccacctttctcgctggaatcaatttcccagaagggagttgctcactcaggactttgatgcatttccacactgtcagagctgttggcctcgcctgggcccaggctctgggaaggggtgccctctggatcctgctgtggcctcacttccctgggaactcatcctgtgtggggaggcagctccaacagcttgaccagacctagacctgggccaaaagggcagccaggggctgctcatcacccagtcctggccattttcttgcctgaggctcaagaggcccagggagcaatgggagggggctccatggaggaggtgtcccaagctttgaatacccccagagaccttttctctcccataccatcactgagtggcttgtgattctgggatggaccctcgcagcaggtgcaagagacagagcccccaagcctctgccccaaggggcccacaaaggggagaagggccagccctacatcttcagctcccatagcgctggctcaggaagaaaccccaagcagcattcagcacaccccaagggacaaccccatcatatgacatgccaccctctccatgcccaacctaagattgtgtgggttttttaattaaaaatgttaaaagttttaaacatg

SEQ ID NO: 385391 - DNA, 391 bp, Homo sapiens
ctcttacgagtgaggttaagtattgaacagatatttaaaagctataagcttttaaacagaataggcatattgctgataccagtatttgacaaccgccttgttttttcagataagaaaactgaagcacagagaccataaggcatcagcctatggtcattcacttcgtggtagtcaggtcggaggtcacaccaaggccctctggctactgataatctctgtactaggctgcttttcagtaaactcttgaatgaatgaaagaaagaacacatactgttgacttttgaacttgaatctaaacaaaacctatgttgaactttaagtctgtaatctaagaactatcaaacttaaacttgttacaaaaggagatgatgagcacaaccactttctttgg

SEQ ID NO: 385392 - DNA, 383 bp, Homo sapiens
tttttaacttcttaaacattgttagtggaaaaaaagatatgctctatttaccaatgataatcaaatcataagacatttgcccccaaatgttaccttggatatttccaagagctgttagtcattgaaatcctatttaagatactgttaaaagtttagttaatgtatcacacatatgtcttgatgtatgcttcataggagggactcagtaaagacacgggtattgaaataattaatatataaacattaggggtttcataaaatatataaagaattctagaattagaaagaactcaaaaaattatccagtccagggctggcaaacttactctgtaaatgggcagatagtaaataacctaggctttgtgagcctgatggtctctgta

SEQ ID NO: 385393 - DNA, 409 bp, Homo sapiens
tagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaactaaatatc

SEQ ID NO: 385394 - DNA, 375 bp, Homo sapiens
aagcaagctatacctcttacataaattcagacagtagaaggagtgtgcaatcataatgcttattttatggaaacagtgaaaataattttaattatgacctaaatgcttttaagtaattaaagtcctcttgaattggatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaactaaatatc

SEQ ID NO: 385395 - DNA, 470 bp, Homo sapiens
ccctagcagtactaaagtgtatggattggagtggttattttgtagtattttgaatttttaaaatgctattgtgtaggtcagtggtgcttcggtgcgtgaagcagcctttaaactgcttagaaagtatattaaatatgatagtaatagtaagtgatgtcacccattacagttttacaaggtgccaggcactgtgctaagtgctttcctgtattctttctgttacataatctctgtgcctcaaccttcttgtctgtaaaatggtgagaaaaataataccaatgtcacccagttgttttgaagattatataatttaatatttttatttattcatttttgaagcagggtttcacttctgtcacccaggcgggagggcagtggcatgatcttggctcatgcaacctccacctccgaggcttaagtgattctcctgtgtcagcctctcgagtaactgggactacagatgcacacca

SEQ ID NO: 385396 - DNA, 603 bp, Homo sapiens
tggcaaactccgctccaagggtaggctgtgtccaggactgtactcccgtgtgctttgacagaggtgcttcattttttgttctttcaaccccctgtgaatgtatttatcagcttctctcgctcccgctcgccgttttacaccgttgagccggcgaccaaagcagcagctccaccacctcccaccaaccagagcccacccccccgcacgcccgccgcccacccttcgttttggtttaatttttgttcttttaagctgcttctgcgcttctccatgtgctgtgatctataacctgcctctactgtctggcctcacagggtcctccggggtcacagccctcgccgcacgcacagcctccacctcacaatcctagcagcatgatgggaccccacagtcaggtaaacgcaccgtggcgctcccgcccgccggggacgcggggcgcggaggaagcagagagcccgcagaggaaaaacaaaaatcaaaatgtgctctagccactgcctgcgagtctttattgacaaattaaatttttttagaaatttcttttttctaaagatagtcttcagtcctcggatatcacacccagcttggatacgaaaccaaaag

SEQ ID NO: 385397 - DNA, 1674 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccat

SEQ ID NO: 385398 - DNA, 982 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccacgacacagtgcacgacacagaccac

SEQ ID NO: 385399 - DNA, 346 bp, Homo sapiens
tccagtgccatgagtttgttttaattaagaaacgaattaatcaccccgacttgtgggtttccactgttctacagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtgattaactcttgggcaactcagttcccatttcataggcggcagggggtgggagaggaaggggt

SEQ ID NO: 385400 - DNA, 311 bp, Homo sapiens
ttactcgatagcctgacagcataacaacatcattactacaaataagccatgcacatgaacttattgctcaagtccacatgttcactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttaatcagtgacagtttattaacatgcttcaaaagtgaccaaagtgtcca

SEQ ID NO: 385401 - DNA, 454 bp, Homo sapiens
aagaacatgacagacatcctctgcccttcagcctgtgccccagaatgagagacccatgggacagactcaagctgtaccctgaagcagagctgcccagttgactgcagacctaggaggctggagaaaaaagaatccgttaaaggataacaggaagaatagcccgagaggaagagggaaaaccaggagagagtggagccctgaagctgtgtgaggagagggtttcaggagcatgggaacctctgatgctcagacaggggtgtgctgcgccattctgcaccatgtccctgggcgtggtggcgtgcacctgtaatcccagctacccaggaggctgaggcaagagaatcactggaactcgtgagacagaggctgcagtgagctgagatcgcgccactgcactccaaacggagcgacacagcaagactctgtctcaaaaaaaaatattgcagtaaaatat

SEQ ID NO: 385402 - DNA, 3229 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385403 - DNA, 3148 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385404 - DNA, 2814 bp, Homo sapiens
tggcaaactccgctccaagggtaggctgtgtccaggactgtactcccgtgtgctttgacagaggtgcttcattttttgttctttcaaccccctgtgaatgtatttatcagcttctctcgctcccgctcgccgttttacaccgttgagccggcgaccaaagcagcagctccaccacctcccaccaaccagagcccacccccccgcacgcccgccgcccacccttcgttttggtttaatttttgttcttttaagctgcttctgcgcttctccatgtgctgtgatctataacctgcctctactgtctggcctcacagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385405 - DNA, 3088 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385406 - DNA, 2084 bp, Homo sapiens
tccagtgccatgagtttgttttaattaagaaacgaattaatcaccccgacttgtgggtttccactgttctacagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385407 - DNA, 3228 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacaccgaggggtgtgtaccaatacatgatcgcttggtgacctcacgggttttcacctcctagg

SEQ ID NO: 385408 - DNA, 3144 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactgggtgtttttaggtcaggacattgtgaacgaatgtggaacagtcgtgagtcgatgtgaagtttacaatagcatagt

SEQ ID NO: 385409 - DNA, 2878 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagccccccaccccaatcaacctctatgctttcttctta

SEQ ID NO: 385410 - DNA, 2717 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagattctacaaaagagaaaacagcgtacaacgtgggagaatggagacagcgagctatccgcgttttggtactcgagtatcctagtatatggcgtcaggagtgtacaccggcttgggacaatggaaaccggaactcctgcccccctagccgggcactacaatgacgctgatgcgatatct

SEQ ID NO: 385411 - DNA, 1701 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaatcatccacaaacacccccaaactccgactcgagcgggatcgctctag

SEQ ID NO: 385412 - DNA, 1514 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccatcttcagaagacgattatctccagctgaagatgagtgtgtgatcccccctctcgagaagctgagaagcggcttgggcggaaagccaatttgcaaggagggctcggacggggggc

SEQ ID NO: 385413 - DNA, 489 bp, Homo sapiens
ttactcgatagcctgacagcataacaacatcattactacaaataagccatgcacatgaacttattgctcaagtccacatgttcactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385414 - DNA, 892 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaagccccccaccccaatcaacctctatgctttcttctta

SEQ ID NO: 385415 - DNA, 761 bp, Homo sapiens
ctttgtggagtggagagcatttgtgtttgtcactgtgcagtagggcaggctgtcattgaactaattacctataattgcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtgattaactcttgggcaactcagttcccatttcataggcggcagggggtgggagaggaaggggt

SEQ ID NO: 385416 - DNA, 1009 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggatgagacacaccaatcctcggccgcatgccggatacattgg

SEQ ID NO: 385417 - DNA, 2839 bp, Homo sapiens
ggggtgatggcgaggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385418 - DNA, 2840 bp, Homo sapiens
aagaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385419 - DNA, 3291 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgcagcccttcctgacatgtttggggaatgtgggttggagtttattacactgattacaaaatgcaa

SEQ ID NO: 385420 - DNA, 1979 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttctta

SEQ ID NO: 385421 - DNA, 3105 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactgtagggtgaggtgcgactacgcggggggatcctctag

SEQ ID NO: 385422 - DNA, 1215 bp, Homo sapiens
cttgcaaatggataaaacacaggaaaatcctgccccccccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgca

SEQ ID NO: 385423 - DNA, 1678 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaactacttggataactgttgtaactg

SEQ ID NO: 385424 - DNA, 1410 bp, Homo sapiens
ggcggcggcggcagcggtgctggaggcgcagagggcggcgcaggcggagccgggcgggcgcgcgagagcggagagcgggcggccgtgcgggcggcggcggcggcacccccaggccgagccggcgcggaaggagttccagggcgatggggccgcggccggggctgacgctttgacagctggaaagagcgcggaccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtgattaactcttgggcaactcagttcccatttcataggcggcagggggtgggagaggaaggggt

SEQ ID NO: 385425 - DNA, 239 bp, Homo sapiens
gaacaatgcaaattttggtcaagagatatcaatgaagagagacacaataaataaactgacttaaaagataattttactgggcaatattgatcaatgagagcctgaggcgaataagtgccttcatccacagaatatcttttaaacttaatatgtttataattatacatggtagagcacatttcctaatgaattatttttagtagtgttcctactttccagtcaaactacttactctattt

SEQ ID NO: 385426 - DNA, 516 bp, Homo sapiens
gtcatctgtaaaatggaggataggggaataacatctgccttaaggggtgggttgatgggtgtctggaatgcagtagcactgtgtaactgtctgcgttatcatcacaggttccccaacctctgtgccatgaggcatttatcttcctgaattcactccccctacctgaggctttgctggaggcatcttaacggcctcttggcccgacccaggctggtaagagccttggcaagcgcacgcctgcgtgcccattctccagagttcctggcctcgcgatcgtgcactgatttccttcagaaccccaggcccgctctggacgtggaaggcagccgtgccgtctgggaaagtggagccgagcccgggacgctgtcggcctaaatggaacgccggccccggggcccgctccccggcgggttcccgagctaaatcctccaactgttccatgacgtcatcgggccccctccccctgctccggcccgcgcggccccagcgtggcgctaaggagtgtggcggtccccg

SEQ ID NO: 385427 - DNA, 379 bp, Homo sapiens
ctgtgtcccctattgccccaagataagttcatttaaaacaaaaaagcttctatctcaggtagaaaacccatcatcactgggcattgtcttccagtgattctgagcagaaacaacggggaacgtatgtcttcattgtgactcagcgagcaaagagatggagtcttttccaagaagaaagtgggagatttgggaccactgacatatttggcccactgattccattcccctagaccaacacgtgttcatcaaattgcatcactcttatggggaacttaatgcaactccggtgcccattgcattagtttttgatgatggaattctctttgtgaacttgaacttgaggggtctggctacccctctgagacttcttttttgagat

SEQ ID NO: 385428 - DNA, 189 bp, Homo sapiens
aatgctagtcctttccattctttttctatcttgcccttgatatcagtgagccatcagaaggccaggaagcagccaggcatggtggcttatacctgtaatcccagctactcaggaggctgaagctggaggatcatttgtagtcaggagtttgagaccagcctgggcaacatagcaagatctcatccctac

SEQ ID NO: 385429 - DNA, 297 bp, Homo sapiens
tcccccaggatcccaaggtgctggagttataggcatgagccacccaccatgccaagtcatcatgtaaagatttacagaaagttttgtgtaaacattgtcttttttttttttttgaagcagagtctgggtggcccggatgtttgacaaattttatggagaggcctagggcattatgagcaattggaaacccccaagggaatgtgcggtgtggctaacagctggggggggtggtgtgtggttaacattccacttcaaagtgtgagtcttaacatggcttgggataaacaggtccgcgag

SEQ ID NO: 385430 - DNA, 272 bp, Homo sapiens
tatagagatggagttctgccatgttgtccaggctggtctcaaactcttgggctcaagcaatccttctaccttggcctctcaaagtgatgggattacaggtgtgagccactgcacctggcctcaagtacagagtaatggaagtttactcaacttcattttaccaccaattgaccatttttcagatgttctagatttatttacacacaacctccttgttgaggctgacctactaaggagcatctgatttggaagagaagaacagtttataactc

SEQ ID NO: 385431 - DNA, 805 bp, Homo sapiens
aatcttgaaattcgaagtcaggatggatctctgatattggaagtaagcactggttattcatctaaccttgccaggggtggaagccttgaaactggaagtaaggagaaatctctactatgcagttctctggtgtttaagccccaacatggtaccacaggcccttattccagcatgagcaaagagggatgccatgtgcacaggctgactccagtgtacttgaggaagagaacaccatgggactgggctaagaccaggacaaaaagacatggtctcctccctgagccaccattcctaatttgttgactttcctagaagtgaaatggagctgggtgagaagaggaagaactggcatggcgaggaagaagagagttataaagacagccctgggacatgcctctgaataaagggatgggttttagttcagtagggataggaacaaagctgaggctaatatggcttccagtctgtaggcagctgttttttcctggtcacctgctaatgtcctcgtctgctttagtgatatcagcacagttatgaactttagcgttggtgattcggcatgtggactagaacttggagctgtgttcacaaaaagtggagctcctcaccttgaggatgggctgtgggataatgagactgatgcagttatctgctgagacaacctgtgattgtgtcatcggaccacgtcagctgctatcattcatgctaaagagactggctgcttactccggcacagctggttagttggaaactagaagttgtggcatctgtagttcggtagctgtcagttgctactaggtaaact

SEQ ID NO: 385432 - DNA, 761 bp, Homo sapiens
atcttggctcactgcaacccccacctcccaggtgcaagcaatcctcctgtctcagcctccaagtagctgggactacaggcatgtgccgcagtgcctggctaattaaataaaaatttttggcagagatgagggtctcactatattgcccaggttggtctcgaactccgaggttcaggcgatcctcctgccttgccctcccaaaatgctgggactacaggcatgagccactcactcagtctggaggccctgttttctgagctgaggtataagtgtcctcagcagcagggcagcacggtgtccaggcaggggtgactcacctccacagaggcctacccgccaagagggtggagtggtgtcctgggctgatgcagaggcagaagtgcgagagcttaggatttcacacaccttttcgtgaagtgctggggtgctgtgctctcagacctcaggcctgagctttcctctggaaggggtttgggttgtgtttgtgtttcctgatgttcaagggtccacaagagcaaagctgggaggggggtctctgtgggagtcggggcacatggggcagacctggggcctttgggtatgtaggggtggcatgctgagtgactccacacccatcatcgggcaaggccatgctggagttttagggggtataagagggctgtgcccctgccaggacatccagctaagccccctgcccagctgggccagcactgtgttcccagcaccccagacattcccatgcttgtggcctgagaccacca

SEQ ID NO: 385433 - DNA, 478 bp, Homo sapiens
ggtcttgctatgttgccagggctggtctcgaactcctggcctcaagcaatcctcttgcttcagcctctcaaagtgttggaattccaggtgtgaaccactatattagacccacatattttctgtgttgtatgtattatatacttgtactcttataataaattaagctaaagaaattgttacaaaaatcataagcaggagaaaatatatttactatccattaagtggaagaggatcatcataaaggtcttccttgtcatcttcacattgagtaggctgaggagggagaggaaggcttggtcttgctgtcttggggtagtgaaggtagaagaaaatccatctgtaaatggacctgtgcagttcaaacccatgttgttcaagggtcacctatacctccttctgccctttgtacatctgttgttgcacttaacacattgtgttgtaattatttgcgtactttatttataataaactgaatatc

SEQ ID NO: 385434 - DNA, 410 bp, Homo sapiens
tcccgattatttgggaggctgaggtgggagaatggcttgggtaagagtgagaccctgtctctaaaataaataaaaggtgtaacatgtgtaataagaacaccagaaagagaagaaacaaaataatataagaaatatttgaaacaagtgactgagaaattcccagaattaatatcagacaccaaaccacagatccaggaagctcagagaataccaaacaggataaatgcccccaaaacctacatgtaggcatttcattttcaaactacagaaaataaaaagataaagaacattcctgaaagaagctggggagggggggaaacaccttacgtatagagaaaaataaaaattatatccaacttcccctaagaaaccatgcaagcaagaagagagtacagtgaagtatttaaagt

SEQ ID NO: 385435 - DNA, 1680 bp, Homo sapiens
ctctcaggcacagaggccaccgttactcctgatgattctgtctcagacccaacaacctggccttcccaggaggtctccatgtgtcaccccctccctgggtctcacccttctcacctgctcaaggaagggatgacctcagtgaggcccagggcctgcagcaaggccctccctggcaattgcagaccaaggattctgctcctccaccttgaactccagcctctttctctccatttttccctctctctcccctacccgtctctccctctctctcacacacacactcttccgggttcaagggccaagcgtctgcctaggctgagacacgtgctgagctccctgaagatggaccagctgccccctagaagggagactttcaggggcatcagggcccttgggatgctccgccctgaccagctttttggtggcagagggaggcacggggagagggagaggccatgtcgcagtccccctgccgtgggagaggcaacgcggaaatgtatagacccagtgctcagccagaaacagggccagcaagcggcagtgaacggaggcagcccggggctcgtcagggtgggcagagccatggcccaggggttgaaaacccccgagttccccgtgagacttggctggcccttcccacccctgggcctcagtctccccatcttgtgtgatgaggagagaccctgaggacagaggtcttcaggctgtgggtctcaacaggaactgagatccccaagggagacagagttgcaggtcacctcccctacctgcttctcagcaggacctaggaggcctggcccagctcctggtggaccccaagcagccagagcctactgctgccatctgaagacctcatctgagcccactttccaccaagcgcccacccaggctgaggtctcctgggaattctcacccgctctcctgctgctaaggaaatgacgtcaatggctaccccagagaaatgccccacatcccaggacaccagccatcaggaaggcagctcttcctcacccagaaagaggcaattatttcctctcagcagcctggccccaggagcccccttccctctctggggctctgcctctccttttgtgccctgccatggagccccagggccggggcagcccctctctgcccagggaaggcaccgccctcaaagacaaggcttggccgggcagtgaccttccctgagcggaggggtggcttgagcaggacacttcttgcccttactcaaaaacgaaatggccagtttccagaggcgtcgggggaacggctgacgaagtcacaatcgttatgttctcaattgttttcctcctcttactttctctcctgcctcgtttggacaggccagtggcattcgcccttgaggtccctcgcagccccggccccccgggcccgcccacacctctggcttcctctgtgcatcctgtgaagtctgtttctgatgcgttggcgtggggggtgggctgggtggggtggggatgagggcccagccctcatgattccatttcccaattcctttctggtctccatcctctctgtagatatgtagatctctttgaaacgaagtaagcacccatccctcccagctcactcggctccaccgtggggacctgctgggggagccgctggctccctgaggaaagtgaaagccaataaaacatctcccacactctcgtg

SEQ ID NO: 385436 - DNA, 502 bp, Homo sapiens
catggtggtgtgcacctgtaattccaggtactcaggctgaggtaggaggatcacttgagatcaggagttctaggctgtagtgtgctatgagcacatctatgaataggcactgcgttccagcctgggcaacatagtgaggccccatctcttaaaagggcacacgtgtataggacagctccattataatcttatgggaccactgtaatatgtgtaatccattgttgactggaacatccttatgcagcacatgactgtgtacataacttaaaatttatcatttaaaccatttttaagtgtacaattcggtggtataaagtacatttacattattgtgtaactatcacctctatccatctccctaactttttcatcatcctaaacaagctctgcccattaaacaatatcacctcatgcccatagcccttggtaaccattgttctactttttgactctatgaatttgtgtactccaggtacctcgtataaatggaattatgtaatat

SEQ ID NO: 385437 - DNA, 648 bp, Homo sapiens
ttgtctaaggggaaatatattctttaagaagaaactatcacatacttctcatccaggctgttctttgggtcgtgggggctcagttgtgataaaaggtgaagttagaactagttaatggagaactagctcccattatgccacttcctggccaaatcagggactgaccatgggactgccccatatgtgaacctatgttgccttcactgagactggggactttgagaagcactggcatatttggaaactttatgcagcagttgactggtctaaaaactacacagatgaaatctctctcagaagaaatatattcttaactatcctactctctttctcctctataataaatgttataaaggtttgcccctgtgtttgttttactttacatgtgaaacaaaaattttcatgggtaaatgagttaaagtatttggcttttagctcaaacaaatgagatgttagtttaagaatagacctccacttataggctgatttataacatttgcattggaggatatggaaaggatataatgaaaacacaaaaatttccgtggcattttaaattttcatttttttatcaagaaaaattgagttcttgttgaaataacctgtacaaaacctgctttaaaaaatagtttttgatgttgcttacat

SEQ ID NO: 385438 - DNA, 273 bp, Homo sapiens
aaggatttagaaacactttggaagctcacgaaaaaacttaagctatttatatgatagttcttgtaaaaggcaggggctgggaacccctttgtactgggtgttgaaatataacaggacatcttacttcagtagcaaggatgaatcccatcatttgtttggtttactttcatatgttacaagcaccgggactactggtgttggttgctggtcacagaagcaaagacaagtaggcttacatgatctaaaattcaactgccagatgactaaacactg

SEQ ID NO: 385439 - DNA, 369 bp, Homo sapiens
agagaaggggtttcgccatgttggccaagctgatcttgaactcctgggcttaagcaatctaccggctttggctttccaaagtgctgagattacaggcatgaggcactgtgcacagccttattattttatttttaatctataccataattctcactccttctatcccgttgtccgcatatatacatatctaccaaagacaggttgagggaacaggaaaatggctgttttaaaatccttgacctttcctgcattgtttatgtatgaactgtcaaatttatatgtcatttttttattctttgacattcatatttagtagacagtataactccctagaagttaatcttgatagttaatttttattacttggga

SEQ ID NO: 385440 - DNA, 2662 bp, Homo sapiens
atcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatca

SEQ ID NO: 385441 - DNA, 432 bp, Homo sapiens
ttaaagtggtgactgtcttggtaggatcatggggacattctgggagcgagctacaccatccaggctgttgaatcagaggctgctttctgtttaatgctgggtttggggagaagagaatcttgaggagtattgtgagctttcataaggcctttcattcaaataattgtatgaataatgaaaggaagagtgagattgaagtttctgccccaggacctctgtgccttccaaaggaagtccctgagctgctctagaaaaggacttctcattcacagcttcctctgaggaccagagggggccaagctgctccatttgttcttggatgtaaaatggatcttgacccactactggtccttaggagagttgttctggtagccagaaccccaagatagatgctggaggaggacattctcttagcacccaacaccagtgatg

SEQ ID NO: 385442 - DNA, 5097 bp, Homo sapiens
atcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctgactgcgccgcctgccctcctgcccaccctcccacccacccgaccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatcattctgaagtgccaaaggagcccccccattcctgggcctttctgagggcaggaggggcgaccagataaggagcccctctctgctgggggagaagggaagacgaggaaccccacatgccactcgctgccttgtcccacagcttgctgccccatttctttgctcctggcacctcgtcccttttagtccctcagcttgataaagagtgagtttggagcccgcattgggctggcccactgggttgctgtgctgtagggtgatcggctgttctgggtagcctggggctgaggaggtgccctggactcagggctatcctgtcctgtcttggatcttgcgggacgagttagtcaccgctgtgtgtgttgcagtgtgcctctgccccatgggcccgagagaagctgacaattacccatagtgaggtaattgagggctttgatactgagctgttctcatatcatactgttggccttgtttttcattttcttttcaaaattagaagaatcaaaaagtgatagaatattgggggaaggagggcagactccatcgtttcctcagggagactgggcggaggtggggttggtctggaagaaggtccatgggggcagggagttgcgaggtggggttagttgcatggaccaggtgaggtggtggaacaaaaggccaggtagaggaagaatattcccttgggtttggacccatggtcccaggtgagagaaggaagtgaggccatagatgcagggagtagaagctttgtggtgtcaggcaaacggactctgttagtaagagttgggggaggtgcccaggtgggtggaccagtactccaggtgatggggcatgctgagaaatagagaaaagagaccatgtttatttgggtaggaggaagccttgccttgcgccttaggtgagaagcataagtgtaactcccatccaccagggaagttgcttgtagccccaaaagtaaaggcctatctctgggtcataaatcctgcaggcagtccaacaaacagggctggctccagcacaaactctcccttccacctttacgaccctctccagaccagacctggagtcctcttcaagcagcaatccaacccagagcaggggccctccccactcaggcatctgataacctctgagatttccaggcctatccctgtgcaggtacagctgcagggaagcccagttttctaagcctaggaccacctaacagcgccccctccttcagttgccctttctgaggcaactaaactacagaatcagggaaagaaccattaggagtggaactgggggaatctgagttgtgtcacttcagttcctctcctaaagacaaaggttagtctgatctccagacccgtcagaatggaatacacagcccacatctgtcactgaaggaggtggagctcccacagccagcagtaatcagggagctgagagcctggttctgtgatcatggagaaatacaaagtcctattgattgcttcttctatagccttgtagagtttctagagagatgtatttatgagggtgataactagcccaggattgatttctttcctaaagtccctagtgacatgattgagcagtaaagaacggccaaatcacacagtcagctaaaagcactgtggggaagagagtgtttataattatgttatttattgctggatgctgagaatggtctgatattcgtgctacctaggcaatccattgacatttctccaatcagagcatgtggaccttggagccaggcatgctcagagaagcctaggtgggctaccatgaccccgaggaagagcaggctttgttttccatcagcacgttgggggccctgccctgaatggtcaatttttcacatatatatctctctatttttttaatcaaactctggtctcactgccttatctcacaccaactctgtttcctcattgccccctgagatggcctgtcttctggggtatagcttggatgtcttcttggatggttctgcttagaatgagtgtcaaggaggaaagagagggagatggaggatgtgtttgtgcgcctgtgtgtgtgtgtttgtgtgtgtgtgtgtgtgtgagagagagagagagagagagagagaccagcatcttcaagagaagtattctgcttatacaaaatccttaacacctcatggtgttattcttcaccatgtttatatatatatatatatatttttttttttttttagaattttctacccttggcatgaggggaaatgattgatattcaagcaagttctctaggaaaaaaaaaaacttcccaactcagatttctgtgtcagctcagaatgtatctttttttcatgctttgctctttggatttataactctgtttagactattccatacattttaggtatattttgtgccttcagacactgcaaataataatcagcatttggattaaagttgtttaataata

SEQ ID NO: 385443 - DNA, 2323 bp, Homo sapiens
atcgctaccgggacacgcttcgccgcgccatcctgctgctcagcccacagggagcccactccttcatcaacgaggccgtggagaccaacctggcttccaaggacagccactgggtctttgtgaatgaggaaatcagtgacccggagatcctggatctggtccatagtgcccttggaaggatgaccgtggtccggcaaatctttccgtctgcaaaggacaatcagaaatgcacgaggaacaaccaccgcatctcctccctgctctgcgacccccaggaaggctacctccagatgctgcagatctccaacctctatctgtatgacagtgttctgatgctggccaacgcctttcacaggaagctggaggaccggaagtggcatagcatggcgagcctcaactgcatacggaaatccactaagccatggaatggtgggaggtccatgctggataccatcaaaaagggccacatcactggcctcactggggtgatggagtttcgggaggacagttcgaatccctatgtccagtttgaaatccttggcactacctatagtgagacttttggcaaagacatgcgcaagttggcgacatgggactcagagaagggcttgaatggcagcttgcaagagaggcccatgggcagccgcctccaaggattgactcttaaagtggtgactgtcttggaagagcctttcgtgatggtggctgagaacatcctaggacagcccaagcgctacaaagggttctccatagatgtcctggatgcactggccaaggctctgggctttaaatatgagatttaccaagcccctgatggcaggtacggtcaccagctccataacacctcctggaacgggatgatcggggagctcatcagcaagagagcagacttggccatctctgccatcaccatcaccccagagagggagagcgttgtggacttcagcaagcggtacatggactattcagtggggattctaattaagaagcccgaggagaaaatcagcatcttctccctctttgctccatttgatttcgctgtgtgggcctgcattgcagcagccatccctgtggttggtgtgctgatatttgtgttgaacaggatacaggctgtgagggctcagagtgctgcccagcccaggccgtcagcttctgccactctgcacagcgccatctggattgtctatggagccttcgtacagcaaggtggcgaatcttccgtgaactccatggccatgcgcatcgtgatgggcagctggtggctcttcacgctcattgtgtgctcctcctacacagccaaccttgctgccttcctcacagtgtccaggatggacaaccccataaggactttccaggacctgtccaaacaagtggaaatgtcttatggcactgtccgggattctgctgtatatgagtacttccgagccaagggcaccaaccccctggagcaggacagcacgtttgctgaactctggcggaccatcagcaagaacggaggggctgacaactgcgtgtccagtccttcagaaggcatcaggaaggcaaagaaggggaactacgccttcctgtgggatgtggccgtggtggaatacgcagccctgacggatgacgactgctcggtgactgtcatcggcaacagcatcagcagcaagggttacgggattgccctgcagcatggcagcccctacagggacctcttctcccagaggatcctggagctgcaggacacaggggacctggatgtgctgaagcagaagtggtggccgcacatgggccgctgtgacctcaccagccatgccagcgcccaggccgacggcaaatccctcaagctgcacagcttcgccggggtcttctgcatcctggccattggcctgctcctggcctgcctggtggctgccctggagttgtggtggaacagcaaccggtgccaccaggagacccccaaggaggacaaagaagtgaacttggagcaggtccaccggcgcatgaacagcctcatggatgaagacattgctcacaagcagatttccccagcgtcgattgagctctcggccctggagatggggggcctggctcccacccagcagagctttttaatacaagaaaacaacaacacaaaccacacacactcgcacacacacacatacacagagactctttcatttttcttgtacatatgtgtaaataatgacagaatggagtggggtaaaagtgtattttgaatattcccaattttcgaagtcagtaaaaaaacacaaaaactgtatgaatgactttgtaaattttgttctatatgaataaaaaggcaaattacttgtgatca

SEQ ID NO: 385444 - DNA, 3006 bp, Homo sapiens
gtataggacgctatctcagcacattatccgaagaaaattccagttaaaaatcatctcatagaaaatatgactagtatttacagtccagtcaagctttatgattcttatgtcgattttttctttgtgattgactctttcctattccctcctcttctcttaacaggtaaatattgtcacagccctaagttcagagccaggcctggctctgaacttaggctaactcgttggaattctccaaagcaatcagtgtgagccagtgcctcttccttacccacatctctactttcaagaagctgccctgcatttcctggggcaaaactctactttgtaagaaaaataataggaccagaaatttaaatcccaaattgaactatggaacttgaactctagcgtgttcgccccaactgggagaggtgagctttttcccagtgtttcagaactgattttctttactttctacaagggagggcagcacagggactacggttgaggcccgtgaaggctgggtttgatgccaccctatacagagcagggacctctctggctaatccccagtcctcagccaggctgtgtgaatcaagtgcctgccccagggctcttgagctattgaagctgcttgggtacaggacacagtaggtggggagggttaagacccttctgtgagttccctgtgcggggctgtacttgcctcttccaattcgtggcctttccctgcttggtccctactagacagacaaaccagccacagtccagcctgcagccagaccaccttgttcactcattctcctttgcctcagagctaagacaaaaatgagacagaaggcagggctccctgggagtccactgtgctccagggttctggggaatcagggttagccagcagctcctggctgcttccctcagagactagggctctcatcctccccaagagaagcagcaagcccagcctggaccacactgtccatattgctggacagtggcctgacagaaagtgactcctccaagtcccaggaggccagggcttttctcatccttgcctttcagccctaacccatgggactgcccacggattggagacttcaagggctgaggtctgggagctgcataaagggcattgcttcagcccaagttagaaatctgcctgggcaagctcttcctgccccagacctacaaagcagcagaccgggggctctggtggactagcccctgacattggtggggggccccacaccactccaccccaccctgccttccagctctcctgggcatttttctccctgtactcaaacagcctacccacccaaggtttcctccctgggcagcctagcaatgaacagtgcagccggcagggcagaggcccggcagtcaccgggcccgtcaggctcaggcagagaagccacaggggccaggagtcactggagactatttctaaatgatgggggtaaatgcacaaatagaatctcaccaaagggctgcctccacattgatgccgtgcccagagggacagaaccaatgccaccagcctgggtatatgtcactgggcacagctctaaccccctcctccggactctagtcccgctcctctgcgcacagagcccccagcccacaggtacaccttcatgatttggagaaagacgctcgccccatgcacgccctcctctgggccttctgccctgctcccagtcacttccaagcttcctgtttgcctgtgatgttattgtgcctgttgagggaagcagcagaggaggcagtggctgacttggcacagatgcctgctacgtgctctgttgaaatgcgcggggtggccattcctcggtacagactagtcctggtccttgggtgtgggcagtgggggaggaaccaactggtcgaggtttcagagccaaaccttgcctttggttggtgagtccttgccccccaggcctgcgctccacgatgcctttcacccttggcaatctcagggccatcctgggtagtaaccccactcctctctgctcccgcccgcacctgtggctctcactctgggctcaacccctgcaaccctccaggagcccgacagcagccagctgcctgcactgtcgcctccgtaagctccaacttccagacccagaagtccctctgcttccctctgttggaaaaagcctaaaagaattagcttccagattcctctagcccctgctccattcccacccagtccttctgaagaggaatgagcaatacatctgagctggatttctctctagtcctttctccagacaaatccttcttaaagcaaaagtcctggctgagcacctgtccttggggaccgatctgccgtgtgaccaggggaagaaagttcccgaaagcctgttccaccaattctgcttctgtgttgtgaatccagtctgctttccattagaaaaccgcttcggcacttatggtcactttaataaatctagtatgtaaaaaaagaaagaaagaaaagaaacagaaaaaagaaacgtgcaggcaaatgtaaaatacaatgctctctgtaagataaatatttgcctttttttctaaaaggtgtacgtattctgtatgtgaaattgtctgtagaaagtttctatgttcttaaatggcaatacattccaaaaattgtactgtagatatgtacagcaaccgcactgggatggggtagttttgcctgtaattttatttaaactccagtttccacacttgcatcttgcaatgttggtatggtatatatcagtgcaaaagaaaaaacaaaacagaaacaaacaaaaaaaaaaaacaaaaatccacgcaggtctaaagcacagagtctgacgtacaaaaggaaaaatgctcagtattgatgtgtgtgacctttgttgtaaattacatctgtactgtgaatgagaagtttttacaagtataataattgcctttattacagctctggctgagtgttcagcctgaggatattttttaaaaaaaaaagaattagcatgttggaataaatttgaaaatcccaacataaaaaaa

SEQ ID NO: 385445 - DNA, 270 bp, Homo sapiens
tgaatggagaaataaactgtggtacctccagacgatggaatattcttcttctgtgctaaaaaagaaatgagctatccagccatgaaaagacatggagggaattactacgtgaaagaagccaatctaaaaaggctatatactgtatattccaacaatatgatactctggaaaaggcaaaactatggagacagtaaaaagatcagtgtttgccaggggttaaagaggaggaatggatgaataggcagaacacagagaattccggaggcagta

SEQ ID NO: 385446 - DNA, 292 bp, Homo sapiens
tagcatcttacataattaaagcatagttatcgaaaacaagaaatcaacattggcacaattcaattaactagaggccatattcagatttcacgatttcttttagttgttatttttccttagtgtctagtctatgacagttcctcagtctttacctgtcatttgtgaccctttcttgtctttgtgaccttgacacttttgaagaatactggtcagttattttgggttcggtgttttttgtttttaaaaatagacacgtggtcttgctatgttgcctaggctggtctcgaactcc

SEQ ID NO: 385447 - DNA, 347 bp, Homo sapiens
tatctagacattttaccgagccatcaaagggatgaccaaatctgtcctcttctctccttaccactcccctccccactcttcctcttcccttctctcatttatttattatctatttgtctatctatccatctgtatgtctaacctcaatcagtcatctgtgagtcatgtctttgtctactttgttttgttttgatggaatggcagcaaaggatgataagagagcagtagttgtctgaagtctcaaatatcactggagtttgttcaaagtgttgcgtgaaggtagttcagtcatacctagcttgtattatttgttgaaatcgtggtcaaggaagaaaaggacttttctg

SEQ ID NO: 385448 - DNA, 900 bp, Homo sapiens
gggagacatggttcatttcatagcatatgggaaaggctgagggaagagcaggtttaggagatgagtacaagagctcagggcctctgatctggacatgatcttcatcagatcacactccagctatgacagtgattgtccaagctccattccctgtctctcctcccagactaggacatcttcttcttctgggttcccacatcattctaggttccagtggcacttttcttacttgatgcaaggatgtgggatttgggaacatggtttcatctctccaaccacaataccagcaactttcaggcaactgtctgatgccacacagcaaatctgccccagggcagagggggcagtaggtaggcagtaactgggagcacaggcagagaggctggcatgaagaaacctgcccatgggaagcagggccaatgccacctaggctgggttcaaggatgtggccaaaaaagcagaacttccgacaaacttggaaaactagtcaggttactgaaacaggaacttaagcttctcagcaaattagacgtaacatataaactggaaaaatcagtgaacttgaagatagagcaacagaaatgatctaaagaaatataaagagagaaaagaaggctgggggacagaacagagcacccaagcattgtgagacaacataaaatggtctaacatatgtatagttgggatctcattaagaaaagagagcagagtagaactatttgaagagataatgaccaagaacttgttaaagaaaggcaacataccacaagtccaagatactcagagaaccttaatcagaatttttaaaaaaatccacctagatgtgtcatgatcaaactgctaaaaaccaaagataaattctgaagacaaccaaggaaaacagaatgccggtgtccccct

SEQ ID NO: 385449 - DNA, 412 bp, Homo sapiens
acattctttccagatatctaatataacaaactgaaacttataattagttattaaattttcacatattaactttaggataggaaaccactacttaatatattttaacattttactcctggctattaacatttacaacatgggttacaaataggtatcatacctctaaaggaagtaacagaaacaattagtaatctctctctgttctttttcatagagatttcaaaataaatctaaggttatgcataggatgtgggtttttctccgggagtagtattacagaaggtttgtggtattagaagggtcatgacacaatgcaagttgcttagtctcaaacacaagcgtaaagctttcattttaagaatattttatattatacccacagatgaaaaatctaacaaaaagagacacggtg

SEQ ID NO: 385450 - DNA, 475 bp, Homo sapiens
ttgataatgacctgggaaagagggccgagtgggatgagggtgggagtaggaaagaaacattcggcccacacagtgttcatatcttctcttgtttttgtatctgtggcaactgcagattaaatgaattaggttattcttttccattgccttctaccaaatagaagtacttatttaagccttgcagatttttttcctgctgagtgaagcctgaactgagcccatgaaaggtgatctctccaaagcaagggctcctgtttccttccttccatcctgctatctcattcaagtgaaattcctgccatggcatttatcctgagctttgtcacacaggattactgtgatggtccttactatgaatggagtgttaaggtgttttctttagctcgagataaaaaccagttttaggaatgaattctcttttgctgtgaaaaacatgttctaagggaacaaacctcgcctcatttccatttttaca

SEQ ID NO: 385451 - DNA, 1165 bp, Homo sapiens
agaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcacacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgc

SEQ ID NO: 385452 - DNA, 362 bp, Homo sapiens
cccaccttggagaaccagcagatacctactctctgtgaagacttccctaaaatttcttggttaagggtgatttatctgaccctttcctttcctttcctttcctctcctttctcctttttcctttcctctcctttctcctttttcctttccattcctttcatttctcctttcctttcctttttcctttcctttctcccttcctttcctttttcctttttctttgttgagacagggtctcgctctgtcgcccaggctggagtgcagtggccccgtcttggctcactgcaacctctaattgatcctcccacctcagcctcctgagtggctgggactgcatgcgtgtgctgacacgcccggctaat

SEQ ID NO: 385453 - DNA, 139 bp, Homo sapiens
ggctctaaaccaggggagcgggagagacgcagtgtaggacagtatcggggaagagcaggcctgtgtcttctccggtggcctcagggaatgagggagaaggaaggtgctggggaggctggcaaggcctggaggatgcagg

SEQ ID NO: 385454 - DNA, 277 bp, Homo sapiens
gggaggggaggggaatggggggaagggaaagagagagaaaagaaaggaaaaaagaactattattaccgatgaagtaaagattaagaaggtaagagaatacgatgtaaatgtttaagttaataaatttgaaaatttaaatgaaatggacaaattactggaaaagtattacttagctaaatggaattgaggaaaattataattttccaacactttttccgaaagtgtttaaaattcttctataaataaaatgccaagtccagatgattttacaagtgaa

SEQ ID NO: 385455 - DNA, 409 bp, Homo sapiens
ctgcctcagcctcctgagtagctgggattacaggtgtgtgccaccaagcctggctaattttttatatttttagtagataccggggtttcatcatgttggccaggctggtctcgaactcctgacctccggtgatccgcctgccttggcctcccaaagtgcagggattacaggcatgagccaccgtgcccagccaactctgcttttaaggggcttattgactagatcaggctcacccagataatctcccttctttaaggtcaaccaattgatcagtaacaccattaattacctatgtagcacacattaattagatttgaaaatctctgtcatgatcacaggaatcaggtcgacatccatggacctgcatcaataacaatatgattaataacagcagctgtcatgaatcaag

SEQ ID NO: 385456 - DNA, 1167 bp, Homo sapiens
gaacatgtaaaaagggaaaataatcaatggtagctttttaataggaacaagagactgactttaccttatatatgactgcaatacagcaaggagttctgcaacaggaaattccagaactatgtcacacatgctaagcaaatgaataaattatattaagtaactaatcaggccaggcaagtaatgtccaaagaatgtcacagctataaatgagagaataatgagcagaatataagaatatagggtgaatgaatgaattacaaaaaccagctgttattttaaaatagtctaatgtgtatatacaacaaatagaatatatatgaaaattaaaaaaacaaggcaagaagttttttttaaaattttggtccatctagtcttacattgtaagaatgtagtaccttgtgaaaaataacgatccatcagtaaaaatttaaaaaacgattcactgtgaactagagatttagaattcaaactgtccaagatgaaaatgtcatctcaagatccacttatgagtaattgttaaagtttttggaattttcatgctaggaggtgaaatctgttgcaaagctgaatttataaggttaggggggactgtccattaagaatacttcttctttacacagagactaatggcttctttgatggtccaaagcataggcacctgaattctgaaacattatccatcacaaatctccagcattcttcagaggaaacacacaaggcaactttcagcttctttgattacaaatgccaaagttttttttcaggctagtagatttaatgtttcatcccacattttagccctgctacaagaaaatatcttttatttcaatacaaaccagtgatttgcaagcctggctggtaatcagaatcaccttttaaaaattataaattgccagccaggtgcggtggctcacgcctgtaatcccagcactttgggaggctgaggcaggcagatcacgaggtcaggggatcaagaccatcctggctaacacggttaaaccccgtctctactaagacatacaaaaaaattagctgggcgtggtggcaggaacctggtagtcccagcaggagaatagcatgaacccgggaggcagagcttgcaataagccgagatcgcgccactgcactccagcctgggcgacagagcgagactccgtctcaaaaaaa

SEQ ID NO: 385457 - DNA, 356 bp, Homo sapiens
tcacttctcttggaattactgtatacctttttatgattccattttatctccttgttggtttattagctctaactctattgcggcccctgggtgaactttaaggaatattccctctccttctctggcctcagatagttttctcacacatatgcactaaccagtacttagttaaacactagggtaggacctcctgggagatagccagagtgttctctctgtgcagctttcttctttctggtaatctgccctgcaaacccaaaccactgtggcctcttcagattccaggtctggctccccagttcagaggacctccagaatatgcctgggctgctcctcctggggctggtatctggaaa

SEQ ID NO: 385458 - DNA, 719 bp, Homo sapiens
ctccagcctgggtgacaaagcaagactttgtctcaggaaaaagaaaaaagttactaaaggaaatcatctgaaatgtaaagactatttgtaaatatgttcattcctgtgtttttcttaatagcaaagatttgggtatgccctcaatgcctattaattggggacttgctaagtaaattctctagatactgatattatatagtcatttacaattatattaatgaaaaagattaatgacatgggaaggattgtaatgtaacattaaaggagaacgtaggactaaaaaactttttctacaccgggaactcaaccatgggaaaattctacacacgcatgcacacatacatacaactgggaggaaatattccaaaatactagtactgactatcttggatagtcagtgaatttatagatgacttctgttttcttctttgtatttctattttactacatcttctaaattttctacaataagaaaatactttctcaatcagaaataaggtacttaaaagaaatgtatcacacctttctagattgaagtcattcatatttatattacttatcctagcatatataggtatgtatatggtttagacatcagtacaaaaagaaacctcatacccgttagtcatcactccccatttgtccccagcccctggcaaccactaatctagtttctgcctctgtgaatttgttcaggctgttttcttgaattttcagtc

SEQ ID NO: 385459 - DNA, 839 bp, Homo sapiens
tcgtctataaataagtttgctaacacaaagaactgagtcttactcagcatataacttggaggaaagtgtgtgggtgttctagaggacaacctaccagtcttgagcatttgtccttaccttagataataacagtataacttttggagacagtgatgctcgccagtattccaaagctcctgtacatttctcagtcttttctgctgttaggttggggacatttgactaacagtaaccaatggaacttgcaagtaggtgcatggtggtgtatgagatgctggaaactccataatctgagtcatttgaataactgtggaattaagtctccttattgagttaagccactgagatctactttttactgtgggttaagatctactttttactgtgggttaagatcttattgcaacataaccttgcccttcctgattatcatgaaatgtttaacttaaggaagaagagagtccttaagttaatagggtgaatcaactgagttaatggaagttaagagatgagtttttaaaacaattaaaaaaataaaaagaaaactttatttgaacaagaaaaagttaaggatgttacacttcaaaagaattttgaactcattaattatttttaattgacaaatcactgtggatttacagggtactgtatgatttttttgatacatgtgattaaaccaggctaattaacatatccatcacttcactttttggtggtatgaatatttaaaatctctctctgcaattttcaaatatacaatacagttggccctctatatctgtgggtttcacatcctctcattcattcaactgtgggttgaaaatatttagaaaaaaaaa

SEQ ID NO: 385460 - DNA, 658 bp, Homo sapiens
caaataatgaaacatctgaaaaagggaccagtatactgtaaaagtagaatatagaagttctttatgtactcagctggagaaagcaccaagatacgttgtttgtttgttgtttgtttttgtttttgagacggagtctcgctctgtctcccaggatggagtgcagtgatgtgatcttggctcactacaacctccacctcccgggttcaagcgattcttctgcctcagcctcccgagtaatgggattacaggcaagtgccaccacacctggctaattttgtattttttgcagagacagggtttcaccatgttggccagtctggtttcgaactcctgacctcaagtgatccacccaccttggcctcccaaagtgctgggattgcatgcatgagccactgcacccagccaagatacattgttgagtgaaaaaaaaatttcaagatatatagaacagtgtaaacatgcatccaattgtgtttttcaaggagaaaataatgtatacttgtattggtttacgtatgaaacaaaaatatctagaaggatgaataaaaatctagtaactgattatacactagggcaaattggaaacaaatgggagacttcatggatgacttttttatatttgtaaagtgaagtgatgtattacttattcaacaattaa

SEQ ID NO: 385461 - DNA, 486 bp, Homo sapiens
aagggatatatttacataattcaaagaaaaattgtatggaaaggtttactgaagagaaatcatgctctttccccaccccagcctcaccatctatcctatataggtgaccactttgattaatttcttttgcatctttccattatttcttgtgcacatatgatcatggtcactccccctggcacctcaagcatggtgcaatatgtagatagactatagacacagatatacttaccccactctcttgcacaaaaggtagcatattatatattcttttctgcaccatgctattttcttcccttaacaatatagcctggccatctctctgcatcagtaaaaagagatcttcctcttttttacatgactatataatattccattgtatggatagattatagttcttttagtctgttccctgttgctggacctttgggtcatttaaaatctttcgctattggccgggtgcctcacacctgtaatcccagcact

SEQ ID NO: 385462 - DNA, 184 bp, Homo sapiens
gtcatcaacctgagggtatcatgctgtcatctcactaaagcaacacccaggcgggtgacatcccagtattcagaacaaattcctgtcatctgggacatggttgggccagtttaatctgtgtcacctgaccaactcatgcagaactgttacctcatgcttggagatgtaggaacaggaagagttg

SEQ ID NO: 385463 - DNA, 94 bp, Homo sapiens
gtacaactggtcagggagaaccaatggcagacatgtgctatatcccaacacaccttgactcttgctctcaccggaagctcagcttagggaaagg

SEQ ID NO: 385464 - DNA, 289 bp, Homo sapiens
cactgcacacctgcggttggggacaggacatgactaagcacagagctttcttcttttgaggccacgcatgtggtgcagagcgggaccacctgcatccacacagcccggcgcacctgctcctacttctgcttagcgtgtgagcagcttggtgaccagggtctccaccagggggcaggccaggaccggcttacagcactttctaggggttctctggtcccgggctgggacacatacagggcttagtaaagttcatagatggtagctaggcagccccaggccccaggtgaca

SEQ ID NO: 385465 - DNA, 194 bp, Homo sapiens
cccccccccccccccccccttaggaggtcgagatggaaggatcgcttaagcccgggagttcaaaactagcctgggcaacttggtaagacctccatcgctacaaaaaaaatgtttttttctttttcttttgagacggagtcttgctctgtcacccaggctggagtgcaatggcacgatctcggctcactgcaacc

SEQ ID NO: 385466 - DNA, 468 bp, Homo sapiens
ctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctt

SEQ ID NO: 385467 - DNA, 423 bp, Homo sapiens
cttgggtacagatgagggatccagagggtagagggtgagaaacttgcccaaggtcacacagtcatgcagctagtaagagatggtgctgggattcaaacctgtggtctcagaactcacccatgttcctctctctctgcagtatagtcgggggaaaagaaaagaccagaagatgcccacagaccaaaaggcacagatacagtgccaaaataagcccaggacaggcaggtgggaccttgccatggttatttgtcctaaccttaccatgaggttaggaccagcaacagctgaaggggcgagagtgctggagagagaggtcacaggggtggacgcccattcctgcctcctgggacaggcgatcttccaaacttcccatgcatagccttatttacccctcccaaaaccctgtaaaaggtaggtgtggcc

SEQ ID NO: 385468 - DNA, 304 bp, Homo sapiens
gggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcagggacagccaagcgttaaggggaaaatgcagagcaaaaggagccaaggacaaagaaagttccatgtacttggagagtaaacaaaaacgagaaatggatgaatagacaagacagcatttttcttctggagtcagcaca

SEQ ID NO: 385469 - DNA, 474 bp, Homo sapiens
gggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggttccagccccgggctcttccatcacatcctggtgggcttgctggtggtggcgttcttctttctccttttccagttctgcacccacattatagtcgggggaaaagaaaagaccagaagatgcccacagaccaaaaggcacagatacagtgccaaaataagcccaggacagggacagccaagcgttaaggggaaaatgcagagcaaaaggagccaaggacaaagaaagttccatgtacttggagagtaaacaaaaacgagaaatggatgaatagacaagacagcatttttcttctggagtcagcaca

SEQ ID NO: 385470 - DNA, 188 bp, Homo sapiens
atggccagggtcagtgtgacctccatttcccattgtgaaatccgagctggttttgttggacagttgagagatgagaggttccctattaatacacatatccacatgccaagacttggacataaaagctaagaatgtggcatgggggaggaggtaggataagtgacagcattctgaacttagagtcccct

SEQ ID NO: 385471 - DNA, 2823 bp, Homo sapiens
gcgattcgagcagtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggaaattatagactggccaggtacagaaggcaggttggctggccagtgggtagaacaggaggtggaggataggcctgaggtgaaggatgagaacgcaggcgtattggaggtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccctgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385472 - DNA, 494 bp, Homo sapiens
tttcgagcggccgcccgggcaggtacgcgggaaggaagtaactactgaattgtcatcacctttaaaaaatttttaatgtaaaatactctcatatatttatctattagtaattttgaatattaagagtgtttcctggttttttgtttttttttattaataagataatattatgaactagatccttataaaagtctcctagacaatttgaggaacaaagtgatcattgagtatccaacattacatgtggtattgaaaggatccaataatgacatgaaagttcttcaccaaggtaagtgtaaatttgtttctgtaatgcttagaatagctttagagaaaccaaagcaaaatatgtccacccttatttctttatatgtgttttcccactatatttacacacttacaggatctactgtatagctagttaatgtgaagaaccaggtaaatgcaatgctgctactcttctgtttctaagagcgtataatcttataaaacca

SEQ ID NO: 385473 - DNA, 3726 bp, Homo sapiens
  misc_feature (302)..(302): n is a, c, g, or t
  misc_feature (410)..(410): n is a, c, g, or t
  misc_feature (624)..(624): n is a, c, g, or t
tttaatattacaaaaagaaatcagatacctaaaacattaaatatgcactgaaaattatttaccaaaaactgaaacaagtaaaaaacattcccttatttgaaaaatgcctttcattagaagccttatgatttagctaaaatgcacagaagataagttattgccaagtgcttgtaggatgccacttgaaaagttcctgtttgagagtccaggtcttatttcctcccaagaaaaatttagttatcaccattttatattttactttgtaagttaatcttttacttgggtatctgatataatctcanttttcttttttatataattgctactaactttgaaaaaaacactgcttatttcaaagagaaataatgtttaaaagatgtgaagcatttaatccttgaatgctggaaacncttttaaagtattgtaagtacatctgtattacattacacacagggaaaagaatgtatgaattctatgatctgtgggcactaaggtggctggtttagaaaaacagtattttgcatttcaagtttcttttcaacataaagaatattctgcaattttaaaaagaataattccaggctggggtgtgtggtcagggaagcataagtaaagttttggttntacagttgttctctaactttagtaagcttggctctgcattttgttaagcacttttatatttttcctgatttgaaaacgattgcgtgagacaaactcagaacatggagaaatcactacatcacatttcttaatgagtgtcctgcatgtcttactcagctatgattatggtgcagataattttttactaattaagaaataccaaagtttgtgaatgatttactcttaaaattacagcaaatttaaatgtatcccaatgataacctcactcttgatcacttgtgttccagtgtgcttttttgagcaggagataaaaggatggagttacagccattaggctggatctcatgagatatgtgttttgcatgtgaatatcacctgtcattggtagagatgaataaaaatgctggagaacttctgcactagactggttgacatgttctcagctttttcttctttgacatgaaatgacattaacatgccaacatattctcatatgtacccgctagtgagctagctagaattccacccctttcactcccaccccagaaagcaagcaagaatgaatgttctggggatgcattttcagccacctcagacttatttttttaaagtaatgatttgagaatttcatgctttaatgaccattagcatctaattacctgtgacacatttggcagctatgtcacgataaactctgtatttcttaaattttacatggcaatataaatttctggaaaccagttataattagaataattgacttttttccaaaagccaattttgtaaccagttattttattgccatgttactagaaattgtcataaggtgattggttgtctttaaggctcaaaataaatatatttgaggaattcaaatagttagctcatcattcttttattcaagaaaaataacaacataaatattattattattttatttttttatttttttgaggcagagtttcactcttcttgcccaggctggagtgcagtggcacgatcttggcttactgcagcctccgcctcctggattcaagcgattctcccacctcagcctcccgagtagctgtgattacaggcatgtgccaccatgccgagctaattttgtatttttagtagagatggggattctccatgttgctcacgcctgtaatcccagcactttgggaggccaaggcaggcagattacgaggtcaggagatcgagaccatcctagctaacactgtgaaaccccgtctctactaaaaatacaaaaaaaattagccaggcatggtggcacgcacctatagtcccagctacttgggaggctgaggcaggagaatcgcttgagcctgggagatggaggttgcagtgagccgagattgtgccactgcactccagcctgggcaacaaagcgagactccatatcaaaaaaagaaaaagaaaattagtaacttgttttagagctttcctaatgtcagaatatttgatttttttttatttagttttagaacctctataataatagctcttgtacctgcctttcttagaaggtattaaacttactatgctataaggaagtaactactgaattgtcatcacctttaaaaaatttttaatgtaaaatactctcatatatttatctattagtaattttgaatattaagagtgtttcctggttttttgtttttttttattaataagataatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385474 - DNA, 2698 bp, Homo sapiens
gcgattcgagcagtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggaaattatagactggccaggtacagaaggcaggttggctggccagtgggtagaacaggaggtggaggataggcctgaggtgaaggatgagaacgcaggcgtattggaggtgaagcaggagacggatagtagtttagtggtaaaagaagcgaaggtgggtgaaccagaggtaaaggaagagaaggtaaaggaagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccctgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385475 - DNA, 3319 bp, Homo sapiens
  misc_feature (302)..(302): n is a, c, g, or t
  misc_feature (410)..(410): n is a, c, g, or t
  misc_feature (624)..(624): n is a, c, g, or t
tttaatattacaaaaagaaatcagatacctaaaacattaaatatgcactgaaaattatttaccaaaaactgaaacaagtaaaaaacattcccttatttgaaaaatgcctttcattagaagccttatgatttagctaaaatgcacagaagataagttattgccaagtgcttgtaggatgccacttgaaaagttcctgtttgagagtccaggtcttatttcctcccaagaaaaatttagttatcaccattttatattttactttgtaagttaatcttttacttgggtatctgatataatctcanttttcttttttatataattgctactaactttgaaaaaaacactgcttatttcaaagagaaataatgtttaaaagatgtgaagcatttaatccttgaatgctggaaacncttttaaagtattgtaagtacatctgtattacattacacacagggaaaagaatgtatgaattctatgatctgtgggcactaaggtggctggtttagaaaaacagtattttgcatttcaagtttcttttcaacataaagaatattctgcaattttaaaaagaataattccaggctggggtgtgtggtcagggaagcataagtaaagttttggttntacagttgttctctaactttagtaagcttggctctgcattttgttaagcacttttatatttttcctgatttgaaaacgattgcgtgagacaaactcagaacatggagaaatcactacatcacatttcttaatgagtgtcctgcatgtcttactcagctatgattatggtgcagataattttttactaattaagaaataccaaagtttgtgaatgatttactcttaaaattacagcaaatttaaatgtatcccaatgataacctcactcttgatcacttgtgttccagtgtgcttttttgagcaggagataaaaggatggagttacagccattaggctggatctcatgagatatgtgttttgcatgtgaatatcacctgtcattggtagagatgaataaaaatgctggagaacttctgcactagactggttgacatgttctcagctttttcttctttgacatgaaatgacattaacatgccaacatattctcatatgtacccgctagtgagctagctagaattccacccctttcactcccaccccagaaagcaagcaagaatgaatgttctggggatgcattttcagccacctcagacttatttttttaaagtaatgatttgagaatttcatgctttaatgaccattagcatctaattacctgtgacacatttggcagctatgtcacgataaactctgtatttcttaaattttacatggcaatataaatttctggaaaccagttataattagaataattgacttttttccaaaagccaattttgtaaccagttattttattgccatgttactagaaattgtcataaggtgattggttgtctttaaggctcaaaataaatatatttgaggaattcaaatagttagctcatcattcttttattcaagaaaaataacaacataaatattattattattttatttttttatttttttgaggcagagtttcacttccagcctgggcaacaaagcgagactccatatcaaaaaaagaaaaagaaaattagtaacttgttttagagctttcctaatgtcagaatatttgatttttttttatttagttttagaacctctataataatagctcttgtacctgcctttcttagaaggtattaaacttactatgctataaggaagtaactactgaattgtcatcacctttaaaaaatttttaatgtaaaatactctcatatatttatctattagtaattttgaatattaagagtgtttcctggttttttgtttttttttattaataagataatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385476 - DNA, 1483 bp, Homo sapiens
  misc_feature (44)..(44): n is a, c, g, or t
  misc_feature (57)..(57): n is a, c, g, or t
agtgaagtagagaccgcggcaatatataaggaacacccgaaaanggcctagttgttnactaactagcatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385477 - DNA, 1469 bp, Homo sapiens
gttaaaggtatcttactttttcatattttctcctgacccccacgcccgcttccatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385478 - DNA, 2640 bp, Homo sapiens
  misc_feature (302)..(302): n is a, c, g, or t
  misc_feature (410)..(410): n is a, c, g, or t
  misc_feature (624)..(624): n is a, c, g, or t
tttaatattacaaaaagaaatcagatacctaaaacattaaatatgcactgaaaattatttaccaaaaactgaaacaagtaaaaaacattcccttatttgaaaaatgcctttcattagaagccttatgatttagctaaaatgcacagaagataagttattgccaagtgcttgtaggatgccacttgaaaagttcctgtttgagagtccaggtcttatttcctcccaagaaaaatttagttatcaccattttatattttactttgtaagttaatcttttacttgggtatctgatataatctcanttttcttttttatataattgctactaactttgaaaaaaacactgcttatttcaaagagaaataatgtttaaaagatgtgaagcatttaatccttgaatgctggaaacncttttaaagtattgtaagtacatctgtattacattacacacagggaaaagaatgtatgaattctatgatctgtgggcactaaggtggctggtttagaaaaacagtattttgcatttcaagtttcttttcaacataaagaatattctgcaattttaaaaagaataattccaggctggggtgtgtggtcagggaagcataagtaaagttttggttntacagttgttctctaactttagtaagcttggctctgcattttgttaagcacttttatatttttcctgatttgaaaacgattgcgtgagacaaactcagaacatggagaaatcactacatcacatttcttaatgagtgtcctgcatgtcttactcagctatgattatggtgcagataattttttactaattaagaaataccaaagtttgtgaatgatttactcttaaaattacagcaaatttaaatgtatcccaatgataacctcactcttgatcacttgtgttccagtgtgcttttttgagcaggagataaaaggatggagttacagccattaggctggatctcatgagatatgtgttttgcatgtgaatatcacctgtcattggtagagatgaataaaaatgctggagaacttctgcactagactggttgacatgttctcagctttttcttctttgacatgaaatgacattaacatgccaacatattctcatatgtacccgctagtgagctagctagaattccacccctttcactcccaccccagaaagcaagcaagaatgaatgttctggggatgcattttcagccacctcagacttatttttttaaagtaatgatttgagaatttcatgctttaatgaccattagcatctaattacctgtgacacatttggcagctatgtcacgataaactctgtatttcttaaattttacatggcaatataaatttctggaaaccagttataattagaataattgacttttttccaaaagccaattttgtaaccagttattttattgccatgttactagaaattgtcataaggtgattggttgtctttaaggctcaaaataaatatatttgaggaattcaaatagttagctcatcattcttttattcaagaaaaataacaacataaatattattattattttatttttttatttttttgaggcagagtttcactcttcttgcccaggctggagtgcagtggcacgatcttggcttactgcagcctccgcctcctggattcaagcgattctcccacctcagcctcccgagtagctgtgattacaggcatgtgccaccatgccgagctaattttgtatttttagtagagatggggattctccatgttgctcacgcctgtaatcccagcactttgggaggccaaggcaggcagattacgaggtcaggagatcgagaccatcctagctaacactgtgaaaccccgtctctactaaaaatacaaaaaaaattagccaggcatggtggcacgcacctatagtcccagctacttgggaggctgaggcaggagaatcgcttgagcctgggagatggaggttgcagtgagccgagattgtgccactgcactccagcctgggcaacaaagcgagactccatatcaaaaaaagaaaaagaaaattagtaacttgttttagagctttcctaatgtcagaatatttgatttttttttatttagttttagaacctctataataatagctcttgtacctgcctttcttagaaggtattaaacttactatgctataaggaagtaactactgaattgtcatcacctttaaaaaatttttaatgtaaaatactctcatatatttatctattagtaattttgaatattaagagtgtttcctggttttttgtttttttttattaataagataatattatgaactagatccttataaaagtctcctagacaatttgaggaacaaagtgatcattgagtatccaacattacatgtggtattgaaaggatccaataatgacatgaaagttcttcaccaaggtaagtgtaaatttgtttctgtaatgcttagaatagctttagagaaaccaaagcaaaatatgtccacccttatttctttatatgtgttttcccactatatttacacacttacaggatctactgtatagctagttaatgtgaagaaccaggtaaatgcaatgctgctactcttctgtttctaagagcgtataatcttataaaacca

SEQ ID NO: 385479 - DNA, 1769 bp, Homo sapiens
  misc_feature (33)..(33): n is a, c, g, or t
  misc_feature (43)..(43): n is a, c, g, or t
cccgtgtcctagaagcttttggctcggggagcncccacacggncccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385480 - DNA, 1259 bp, Homo sapiens
gcgattcgagcagtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaatggtatgagcatagcttcctcaaattcctgggctcgaatggtcctctcactgcagcctcccaacaggctggtaccaccacactcagctaagttttttgttgttgtttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatcta

SEQ ID NO: 385481 - DNA, 8381 bp, Homo sapiens
  misc_feature (3)..(3): n is a, c, g, or t
  misc_feature (702)..(702): n is a, c, g, or t
  misc_feature (730)..(730): n is a, c, g, or t
  misc_feature (1767)..(1767): n is a, c, g, or t
  misc_feature (2149)..(2150): n is a, c, g, or t
  misc_feature (2672)..(2672): n is a, c, g, or t
  misc_feature (3468)..(3468): n is a, c, g, or t
ggngagctcggctcttaagatacgagtctgccaatgctcccggccaaataaaaaacctcttccttctttaatctggtgtctgaggagttttgtctgtgactcgtcctgctacatttcttggttccctggccaggaagcaaggtaattgaaggacagtcgaggcagccccttaggtggcttaggcctgccctgtggagcatccctgcaggggactctggccagcttgagtgacgcggatcctgagagcgctcccaggtaggcaattaccccggtggaaagcctcgtcagagcagtgcgtggcaggcccctgtggaggatcaatgcagtggctgaacactgggaaggaacaggcacttggagtccagacatttgaaacttggtaagactggtcttcggaacttgcccactccatttgagtggaagcgtggcctgatcaaccacggcatgcctgtactggcactttggtttttgtttttgacttgacttgaattgcttgatactttggttttggtttgacctggcttggatttctggatactctgattttggttttgattctggtttggtgaaaactgaaaaagtgtgtgtgtgcactttttacccattctttgttttgtggtgtgcatgtggtgtgagcttggtgttttgtcttgaggaaacatggatcagacacaaaataagcctactcctctaggaactatnttgaaaaattttaagaagggatttaatngagactatggggttactatgacaccagggaaacttagaactttgtgtgaaatagattggccaacattagaagtgggttggccatcagaaggaagcctggacaggtcccttgtttctaaggtatggcacaaggtaactagtaagtcaggacactcagaccagtttccatacatagacacttggttacagctggtgctagaccccccacagtggctaagagggcaggcagcagcagtgctagtagcaaagggacagatagtcaaggaaggattctgctccacccgctgaggaaatcaactcctgaagttctgttcgaccaaacatcagaagatccattgcaggagatggcaccagtgatcccagtgttgccctccccttatcagggagagaggctccccacttttgagtccacagtgcttgcgcctctgccagacaaatgtatccctaggccactcagagtagacaagagaggaggtgaagcctcgggagaaacccctcccttggcagctcatttaagacccaaaacagggatacaaatgcccctgagagagcagcagtatactggaatagatgaggatgggcacatggtggagagtcgtgtttttgtgtaccagcccttcacctctgccgaccttctcaactggaaaaacaataccccgtcctatactgaaaagccgcaagctctaattgatttgctccaaactattatccagacccataaccccacttgggctgattgccaccagttgctcatgttcctctttaaaacagatgaaaggtgaagggtgcttcaagcagcaactaagtggctagaggaacatgcactggctgattaccaaaacccccaagagtatgtaaggacacagttaccaggaaccgacccccagtgggacccaaattaaagagaggatatgcaaaggctaaaccgatacaggaaagctctcttagaaggattaaagaggagagcccagaaggccacaaacattaacaaggtctctgaggtcattcagggaaaagaagaaagtccagcaaaattcnacgagagactgtgtgaggcttattgtatgtatactccctttgatcccgatagccctgaaaatcaacgcatgattaacatggctttagttagtcaaagcacagaagacattagaagaaaactgcagaaaaaggctgggtttgcagggatgaacacatcacagttattagaaatagccaaccaggtgtttgtaaacagggatgcagcaagccgtaaggaaaaccacatagagaatgaacgtcaggcccggcgaaacgcacctgttagctgcagcaattagaggggtccccccaaagaggcaagggaaaaggggggccctgggaaagaaactcagcctggctgtcagagcttgcagtgtaatcagtgtgcttatcgtaaagaaannggatattggaagaacaaatgccctcagctaaaaggaaaacaaggtgactcggagcaggaggctccagacaaggaggaaggggccctgctcaacctggcagaagggttattggactgagggggactgggctcaaggacctccaaagagcctatggtcaggatgacagttgggggtaaagacattgattttcttgtagataccagtgctgaacattcggtagtaactgcctcagtcgcccccttatccaaaaagactattgacatcatcggagccatgggagtttcagcaaaacaagctttctgcttgccccagacttgtactataggaggacataaagtgattcatcagtttttgtacatgcctgattgtcccttgcccttgttgggaagagacttgcttagcaaactgagagccactatctcttttacagagcacggctctttgctgctaaagttacccggaacaggagtcattatgacccttatgctcccccgagaggaggaatggagacttttcttaacngagccgggccaagagataagaccagctctggctaagcggtggccaagagtgtgggcggaagacaaccctccagggttggcagtcaaccaagcccccgtgcttatagaagttaagcctggggtccagccggttaggcaaaaacagtacccggtcctcagagaagctcttgaaggtatccaggtccatctcaagtgcctaagaacctttagaattatagttccttgtcagtctccatggaacactcccctcctgcctgttcccaagcctgggaccaaggactacaggccggtacaggatttgcgcttggttaatcaggctacagtgactttacatccaacagtacctaacctgtacacattgctggggttgctgccagctgaggacagctggttcacctgcttggacctgaaagatgctttctttagcatcagattagcccctgagagacagaagctgtttgcctttcagtgggaagatccagagtcaggtgtcactactcaatacacttggacccagcttccccaaaggttcaagaactcccccaccatctttggggaggcgttggctcgagacctccagaagtttcccaccagagacctaggctgcgtgttgctccagtacgttgatgaccttttgctgggacaccccacggcagtcgggtgcgccaagggaacagatgctctactccggcacctggaggactgtgggtataaggtgtccaagaaaaaaagctcagatctgccgacagcaggtatgttacttgggatttactatccaacagggggagcacagcctnggatcagaaagaaagcaggtcatttgtaatctaccggagcctaagaccagaaggcaggtgagagaattcttaggggctgtgggtttttgcagactgtggatcccaaactttgcagtattagctaagcctttgtatgaggtcacaaaggcgggggaccaggaaccttttgaatggggatcccagcaacagcaagcctttcatgagttaaaggaaagacttatgtcagtcccagccctggggctacctgatctgacaaagccttttacattgtatgtgtcagagagtgaaaagatggcagttggagttttaacccaaactgtggggccctggctgaggccggtggcctacctctctaaacaactagacggggtttctaaaggatggcccccgtgtttgagggccttggcagcaactgccctgctagtacaagaagcagataagctgattcttgggcaaaacctgaacataaaggacccccatgctgtggtgactttaatgaatactagaggacatcattggctaacgaatgctagacttactaagtaccaaagtttgctttgtgaaaatccccatataaccattgaagtttgtaacaccctgaaccccgctaccttgctcccagtattagagatccctgtcgagcatgactgtgtagaagtgttggactcagtttactctgggcatcagtagactgggaactatacgtggatgggagcagctttgtcaacccacaagaagagagatgtgcagggtatgcggtggtaactctggacactgttgctgaagccagatcgtttccccagggcacttcaactcagaaagctgaactcattgctttaattcgggccttagaactcagtgaaggtaagactgtaaacatttacactgactcttgatatgtctttttaacccttcaagtgcatggagcattatgtaaagaaaagggcctattgaactctgggggaaaagacataaaatatcaacaagaaatcttgcaattattagaagcagtatggaaaccccacaaggtggctgttatacattgcggaggacaccagtgagcttccaccttggtgggtttggggaattcctgcactgacttagaggctcaaaaagcagcatctgcccttccgggcatcagtgacagcccccctgctccctcaagcacctgatcttgtacctacttattctaaagaagaaaaggactttctccaggcagagggaggacaagtgatggaggaaggatggatttggttaccagatgggagagtagctgtgccacagctgctaggagctgcagttgtactggctgtgcataaaaccacccatctaggtcaggaatcacttgaaaagttgttaggctggtatttctacatctcgcatttgtcagcccttgccaaaacagtgacgcagcggtgtgttacctgccgacagcataatgcgagacaaggtccagctgttccccctggcatacaagcttatggagcagccccctttgaagatctccaggtggacttcacagagatgccaaagtgtggaggtaacaagtatttactagttcttgtgtgtacctactctgggcaggtggaggcttatccaacacgaactgagaaagctcatgaagtaactcgtgtgcttcttcgagatcttattcctagatttggactgcccttacggattggctcagataatgggctggtgtttgtggctgacttggtacagaagacggcaaaggtattggggatcacatggaaactgcatgctgcctaccagcctcagagttccggaaaggtagagcggatgaatcggactatcaaaaatagtttagggaaagtatgtcaagaaacaggattaaaatggatacaggctcttcctatggtattatttaaaattagatgtaccccttctaaaagaacaggatattccccttatgaaatattatatcataggccccctcctatattgcggggacttccaggcactccccgagagttaggtgaaattgagttacagcgatagctacaggcttcaggaaaaattacacaaacaatctcggcctgggtaaatgagagatgccctgttaacttattctccccagttcaccctttctccccaggtgatctagtgtggatcaaggactgaaacgtagcctgtttgtgtccacggtggaaaggaccccagactgtcatcctgagcactcccaccgctgtgaaggtagagggaatcccaacctggatccaccacagccgtgtaaaacctgcagtgcctgaaacctgggaggcaagaccaagcccagaaaacccctgcagagtgaccccgaagaagacaacaagccctgctccagtcacacccggaagctgactggtccacgcacggccgaagcatgcagaagctcatcatgggattcatttttcttaaattttggacttatacagtaagggcttcaactgatcttactcaaactggggactgttcccagtgtattcatcaggtcaccgaggtaggacagcaaattaaaacaatgtttctgttctatagttattataaatgtataggaacattaaaagaaacttgtttgtataatgctactcagtacaatgtatgtagcccaggaaatgaccgacctgatgtgtgttataacccatctgagcctcctgcaaccaccatttttgaaataagaataagaactggccttttcctaggtgatacaagtaaaataataactagaacagaagaaaaagaaatccccaaacaaataactttaagatttgatgcttgtgcagccattaatagtaaaaagctaggaataggatgtgattctcttaactgggaaaggagctacagaataaaaaataaatatgtttgtcatgagtcaggggtttgtgaaaattgtgcctattggccatgtgttatttgggctacttggaaaaagaacaaaaaggacccggtttatcttcagaagggggaagccaacccctcctgtgctgctggtcactgtaacccactagaactaataattaccaatcccctagatccccattggaaaaagggagaacgtgtaaccctggggattgatgggacagggttaaacccccaagttgccattttaattagaggggaggtccacaagtgctctcccaaaccagtatttcaaaccttttataaggagctgaatctgccagcaccagaatttccaaaaaagacaaaaaatttgtttctccaattagcagaaaatgtagctcattcccttaatgttacttcttgttatgtatgcgggggaaccactatcggagaccgatggccttgggaagcccgagagttggtgcctactgatccagctcctgatataattccagttcagaaaacccaagctagcaacttctgggtcctaaaaacctcaattattggacaatactgtatagctagagaagggaaagactttatcatccctgtaggaaagcttaattgtataggacagaagttgtataacagtacaacaaagacaattacttggtggggcataaaccacactgaaaagaatccatttagtaaattttcaaaattaaaaactgcttgggctcatccagaatctcatcaggactggatggctcccgctggactatactggatatgtgggcacagagcctacattcggttacctaataaataggcaggcagttgtgttattggcactattaagtcgtcctttttcttattacccataaaaacaggtgagaccctaggtttccctgtctatgcctcccgagaaaagagaggcatagttataggaaactggaaagataatgagtggcgccctgaaaggatcatacagtattatgggcctgccacatgggcacaagacggctcatggggataccgaacccccatttacatgctcaatcggatcatacggttgcaggccatcttagaaataattactaatgaaactggcagagctttgactgttttagctcggcaggaaacccaaacgaggaatgctatctatcagaatagactggccttggactacttgctagcagctgaaggaggagtttgtggaaaatttaacttaaccaattactgcctacaaatagatgatcaaggacaggtggttgaaaacatagtcagggacatgacaaaggtggcacatgtgcctgtacaggtttggcacaagtttaatcctgagtctttatttggaaaatggtttccagctataggaggatttaaaaccctcattgtaggtgtattgctagtgataggaacttgcttgctgctcccctgtgtattacccttgctttttcaaatgataaaatattttgttgttactttagttcatcagaaaacttcagcacatgtgtattatacaaatcactatcgctctatctcacaaagagactaaaaaagtgaggacgagagtaagaactcccactaaaagtgaaaattctcaaagggggggaaatatggtatgaggtcgccacttctcctgttgtccttctcagtttctccccaacctccccttttccctagtttataagacaggagaaaagggagaaagcaaaaagttgaaaagaaacagaagtaagataaatagctagacgaccttggcaccaccacctggccctggtggctaaaataataataatattattaacccctgaccaaaactattggtgttatctgtaaattccagacactgtatgagaaaatactgtaaaactttttgttctgttagctgatgtatgtagcccccagtcatgtttctcacgcttacttgatctattatgactttttcatgtagaccccttagagttgtaagcccttaaaagggctaagaatttctttttcggggagctcggctcttaagacacgagtctgccaatgatcccggccgaataaaaaacctcttccttctt

SEQ ID NO: 385482 - DNA, 377 bp, Homo sapiens
tcactgggtccataaatcctgtcctggttatctccccattctctgtaaaaaggattctctgtaaaaagattacatcgccctaaaccaggacctgagctcttggactgcggcggccatggcggctcagattacccagcgcaagtgggaggcggcccatgaggcggagcagcagacagcctacctggagggcaggtgcgtggagtggctccgcagatacctggagaacaggaaggagacactgcagcacacctgtaccagggaccacgggcgcctccctgatcgcctgtaatctcccgggctggcctcccacaaggatgggagacagatgggaccaacactagaatatcaccctccctctggtcctgagggagaagaat

SEQ ID NO: 385483 - DNA, 1104 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaaggtaagtaaaccttaatagtccttacaatgcaatttggattgtagacaagggtttcatattttggcactattgacactggtgttggataattctttgttgtatggagctgttatgtacatgttaggatgtctagcagagtccctggcctgtaccccccagatgccagtagcaccttccagttgtgaaaaccaaaaaagtcaccagacattgctaattgctgtcagttgagaaccactactttagactctaaaatgtgttttagtctgtaaatgaggtgtattgcatttag

SEQ ID NO: 385484 - DNA, 6444 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385485 - DNA, 6390 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385486 - DNA, 6390 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385487 - DNA, 6493 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtgtgccattcattcaaaagagatttatcttctttccccctccccccaccaggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385488 - DNA, 6376 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385489 - DNA, 4007 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagaaaaaaacaaacaaaaaaatttgggggcggcccgaaaatttatacattgtgggcggcccggtttgaatgtgtacgtcaaaactgggatgtggttccaaaaggcggggcttaacaagggtggcggttagcagctgc

SEQ ID NO: 385490 - DNA, 3837 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaaagaatcatataacctacgaacaaaaaagaggggggagctaaaaattcccaggggccacttatcggtccccgttctcggaacaaggggctcaaggagcgtattaaagaaggcgggcgggtgaacagctgaaggaacgtctcggtctgggagaccctggtgggccatggccccccacagtagcccggataataagttttgacccttccctgaatgctatatactctatctactccgcccacatctacactgagccacgtgcacgtcatagatcaa

SEQ ID NO: 385491 - DNA, 3577 bp, Homo sapiens
  misc_feature (3484)..(3484): n is a, c, g, or t
  misc_feature (3486)..(3486): n is a, c, g, or t
  misc_feature (3497)..(3498): n is a, c, g, or t
  misc_feature (3509)..(3509): n is a, c, g, or t
  misc_feature (3512)..(3512): n is a, c, g, or t
  misc_feature (3514)..(3514): n is a, c, g, or t
  misc_feature (3519)..(3519): n is a, c, g, or t
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagctattgtatcngntggactagtannttaagctttgnttnantgcantaattccggcacattgttggcaacattgtgcatgaaatttcgcaagaaaaccagctta

SEQ ID NO: 385492 - DNA, 3532 bp, Homo sapiens
tctagagcggccgcctactactactactactactaaattcgcggccgcgtcgacaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385493 - DNA, 3482 bp, Homo sapiens
ttcaatttctacacagtgatctgctctaagcaaattaatcaaacctgaagaggtaggcatagagaccccgatttacagtgggttggtcaaaagtacaggtcacaacctgtaagcttgtgattggcatcgcaagtgggaggcagtcttggaggattgaaccattaaactgtgggatctgacgctatctccaagtaaatagtgtagaaattgaacgttcaatttctacacaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385494 - DNA, 2495 bp, Homo sapiens
gggaatctaattgttcggaccgggataagtcacatccctgaccatcttatggtattttgaagctcaaacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385495 - DNA, 1846 bp, Homo sapiens
cttgcggtacgccccgaggttttgatatgtcgaccaggcgctcgcgacgcgtggagccacgcgtctgtggacgcgtgggcggctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385496 - DNA, 2252 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtaagttttgataatgtatttatgttttgagggatttgattatagtaagacaatttaggagttagggaacatgtaaagttatcagttgggagaacatctaataatctgttaattccatgattccagaaagggaataggctatataaaggtagctgttggctgtgttcttaaatattcaagtgatgtttatacctttttgtattgtattctagacctccctcacctaagaggaaatcttagaaatcaaaactatgtgttaaagaatggtagaccagcctttgatcatatgcatgatttaaggaattcctggtttttattgtattttaaaaatatttctgagg

SEQ ID NO: 385497 - DNA, 143 bp, Homo sapiens
tagaatcattggaactttaaacttgtcgagatcttagaaatctttgacaggcctcccacttgtaccttggaactactcaaagtcattactgaccacacttcagatttagccatgtataatattcactgatatgtagttccata

SEQ ID NO: 385498 - DNA, 3873 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaaga

SEQ ID NO: 385499 - DNA, 6390 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385500 - DNA, 6361 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttatcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385501 - DNA, 5899 bp, Homo sapiens
atctttgacaggcctcccacttgtaccttggaactactcaaagtcattactgaccacacttcagatttagccattatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385502 - DNA, 4983 bp, Homo sapiens
gtgctcgcttcggcagcacatatactaaaattggaacgatacagagaagattagcatggcccctgcgcaaggatgacacgcaaattcgtgaagcgttccatatttttaaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagcggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385503 - DNA, 3561 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgacc

SEQ ID NO: 385504 - DNA, 4334 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagaaaaaaaaaaaaaaaaaaaaacaaaaaaaaaaaaaaaaaaaaaaaaaaaaaaagaaaaaaaaaaaaagaaacggaagaaagaaacacgaagcaaaccagggaggaatgaagcgaacaacagagacaaaaaagaaaaagatagaaatacaaaacaagtaaagagaacaaagatagcacacaaacacccacaaacataaaacaccaaaaaaaaaaacgaaggaagaagcaaggggcggaacgcccgacacgcaagagccgccgacgaccagacgcataagagagggagcagggaaagaggaagggagagaagaacacaagaaaggaggaaaaggatagacaagaagacaagaacgcagaggggagcaggcgaacaaacaaaacaggagcagggaaaaaccagcgagcgaaaacaaaataaaaggaaaaaaagaaaggaggagaacaagacacagcagggagagg

SEQ ID NO: 385505 - DNA, 3839 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccgaaaaaaaaacaaacaacaaaaaacactgttgttgggcgcgtctctagcccccaaaaaaaggtcttaacaccatctcggctgggcgcggcggccccaacatggatagcgtaaacggtgccacaacgcgttctcccaaagaaacccgggggcacgaacatacgggccgtgctctcccctaataaaaacgccgggggaacacgacgtgtttgtaacaaccccaaggaggtcagaggcaagacggacaacctcccagggcccacacgacggattataatcg

SEQ ID NO: 385506 - DNA, 3092 bp, Homo sapiens
cagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaacta

SEQ ID NO: 385507 - DNA, 137 bp, Homo sapiens
atcgagccggtaccgaattcgacagtgtgcattcttccacatcctccttttccacactaatacaaatatcatatataaacacatgcatctaagttttggggtctaaaaatgggaccatgcagtatcatcaccacctg

SEQ ID NO: 385508 - DNA, 759 bp, Homo sapiens
cccatgatactcacaaagaaaaatctgtagtatagataacacaaaagataaagaaaaaggaatcaaagcataccactacaaaaaaccagcaaatcacagaggaagagagcaagagaggaagtaacaaaaggactataaaacagtcagaaaacattaacaaaatggttaacagtaaatccttacctatcaatacccagtaaaatgatatagagtggctgaatgaatagaaaaccaagaaccaactctatgttgcccacaagaaaatcactttagctttaaggatgcatatagccaggcatagtggctcacacctgtaatcccagcactttgagaggccaaggcaggcaggtcacttgagcccagaagttcaagaccagcctaggcaacatagggagacctcatctctacaaacaataccaaaattagctgggtatgggggtgcatgcctgtagtcctaactactcaggagactgaggtgggaagattgcttgagtctggcaggtcaaggctgtagtgagcagtgattgcaccactgcactccagcctgggcaacagaataagaacctgtctcaaaaaaataaaaaggatgcatgtaagccataagtgaagaaatgaaaagagatattccatggaaatggcaaccaaaaaggacagagctggctatacttacatcagacaaaatagatgttaaatcaaaaactgtcacaagaggtggcacacacctatagtcccagctactcaggaggctgaagcagtggt

SEQ ID NO: 385509 - DNA, 399 bp, Homo sapiens
tatttgacaaatgaggaaacggaggctaggagaaggcagctcacttgcccagttataaatgctaagctgggtatgggggtgcatgcctgtagtcctaactactcaggagactgaggtgggaagattgcttgagtctggcaggtcaaggctgtagtgagcagtgattgcaccactgcactccagcctgggcaacagaataagaacctgtctcaaaaaaataaaaaggatgcatgtaagccataagtgaagaaatgaaaagagatattccatggaaatggcaaccaaaaaggacagagctggctatacttacatcagacaaaatagatgttaaatcaaaaactgtcacaagaggtggcacacacctatagtcccagctactcaggaggctgaagcagtggt

SEQ ID NO: 385510 - DNA, 1009 bp, Homo sapiens
acctgtaatacctaaagtcagttgctattctagatgtctgttttcttggggattattcccctatcatttcatgccaatggatagacactaagatcttgaaatacgcgtaacacaaggtttatcaacagtggcacttggggcctgataattctttgttgtgggaatcctgctgtgcctagtaggatgtctgagcagcaccccagcctctcccactagatgtcggtaccagcaccacccccacaagaggtggcaaccaaaaatctctccagatattgttctaaataatgccccctgagagaggggagataaaatccccctggtagagaactactgatttatatagaacaactcttccttttacgtaagagaagcttgaaactgccccctttcagcgcctaaaaccaccttaagaagaaagtgctaacctaggttaggaggccgaggctgcttcttggagactaagaaatgcactcaagacctataaggcctttccccacagcctgatcctaagtggaaaggccaggagaagcgtggcagagaactatggatcaggcagcccctctcatctttaccataagctaggtgcactgcaaagtacataggaaataagcaggatctgaaacaggccagctgaaactttcaagaggaaccagttcaggcatttccaggtagcaagggaccaccctgggcagctccgccccaagccccaagcccggcggcctgcagggcctcccggggccgggcgcccgcgcggagctcccgccacgcccaccggacgtcacccgttacacaacgccccccgcccccagcttatgcaattctgccctcccgcggttcccaattgtcccggtgacttttgtgggtgaggaagggagacgccgcctgcccggcctagttgccctcgcgggggattctctccccgccccggcagtcgtttccccgcggcgggcccggcccgagagccaattcccggaaagcgcgcggcaggaagcgagcggccgctcgggat

SEQ ID NO: 385511 - DNA, 721 bp, Homo sapiens
cacgcctgtaatcccagcactttgggaggccgaggtgggagttcaagaacagcctggccaagatggtgaaaccctgtctctaataaaaatgcaaaaattagggccgggcacaatggctcacgcctgtaatcccagcactttgagaggctgaggtgggtggatcacgaggtcaggagattgagaccgtcctggccaacatggtgaaaccccatctctactaaaaatacaaaaattagctgggcgtggcagcgcatgcttgtaatcccagctacttgggaggctgaggcaggcgaattgcttgaacccaggaggtagaggttgcagtgagccaagatcgtgccactgcattccagcctggcgacagagctagactccatctcaaaaaaacagaaacaaaaattagccaggtgtggtggcaggtacctgtaatcccagccacttgggaggctgagacagagaattgcttgaatccaggaggcggaggttgcagtgagccgagatcgcaccactgcactccaggctgggtgacagagcaagactccatctcaaaaagagaaaaagaaaaagtcattctagctactcaggaggctgaggcggaaggatcacttgcgcccaggagtttttgagaccagtccgggcaacacagtgagacctcatctcaaataaatattttaaaaggcaataatacacctaaatttagtattcaagagtttagaaaaag

SEQ ID NO: 385512 - DNA, 393 bp, Homo sapiens
gatgaaaagaaggtttttgctcttcaaatgcttaagtaaactaaaaggcagagctggaaataaagcccgtattgtggactccaagtaatgctctttctgctacaccatactttgtggtgtctgctcccatgtgcttcttcgctaaggctgatcaaaaaagttagtaggttgcttcagctataagaatttgatggtcttccttagtcatcatagtctgcagcaatcatttttgttcatcattgggatgtctgcttactcctgttgagtaaatgtgatctattcacccttggaagctccttgcacaccaacagtattcttggatagggacaagtgttgtctaagtcagtgacgatttctttagcataataaaaggctccatgtaggatgctaata

SEQ ID NO: 385513 - DNA, 679 bp, Homo sapiens
aattttacatccctttttttcagctgggtgatattatatgggctatgataaacttagaaccagcaagacagaggtttttattttcagttagtcacctgtctaaaggttaaccagctttcttcctaatacttgaaagttccacctcacatgttaaaggtttcattcctgcctactgaccccacctccagagtcaagcagttatataattgggtacctcattcaaccgttctcattgcattgttccccaccaagaatccaggatgagaaagcttttgctgcttttccatcatgtgttgctagtgtgtttttttcagttctctgtggtatgttatttgctggttattatgagtttccttgatctttgaacactgcctgggaggtccagtgatttcagccttccagaggtgatttaaaaaaaaataatcagggctgggtgtggtggctcattcctgtaatcccagcactttgggaggcaaaggtgggtggatcacttgaggtcaggagttcaagaccagcctagccaaaatagtgaaacctcgtctctactaaaaatacaaaaattagccaggcattggtggtgtatgcctgtggtcccagctactcaggaggctgaggcacaagaatcacttgaacccgggaggcagaggctgcagtgagcgaagatcacaccactgtgctc

SEQ ID NO: 385514 - DNA, 123 bp, Homo sapiens
tgtatcatgtgacaaatgtatcacactcatgaactgggcatggggtactcacaactctaaattattctaaaaatattgatataaatttaagaccaaaaccatggccaggcgtggtgcctcact

SEQ ID NO: 385515 - DNA, 703 bp, Homo sapiens
aacaaacatattacccatcaaacacgcagcccgcctgctgccatttgctgctgtgtgattgttgagactgaagttctgaaagcaccagtgtttgccggatctgtctccagcttgtctctacaaggtcatttccaaaagactgtcaaaagaatggcatgtcccgccttttccaccaccgacacaccctgcatgaaaaccccaggagcacagaagtcctgcttgggtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaacgtcgacttccaacaaaaacaacataattgcctccctgcacccattcccgccagtt

SEQ ID NO: 385516 - DNA, 3378 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctcc

SEQ ID NO: 385517 - DNA, 3544 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaagatgcgacagatgtcaactcacacaacacacaccactaataacacaa

SEQ ID NO: 385518 - DNA, 1492 bp, Homo sapiens
cctcaagtactagaagtatccatttgtattggagccaaaatatccgcaagcagagaaacaagaagtcaaaaatattttcctctttggtgctaaagatttgctgctgtgtgattgttgagactgaagttctgaaagcaccagtgtttgccggatctgtctccagcttgtctctacaaggtcatttccaaaagactgtcaaaagaatggcatgtcccgccttttccaccaccgacacaccctgcatgaaaaccccaggagcacagaagtcctgcttgggtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctcc

SEQ ID NO: 385519 - DNA, 3601 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtactggcctgagtgctcgctgctgttgtagctaccaccaactttctactgaagatgataacccagggcataagaaatgacttcagacccaaggttctgaaagggcccctcaaggcctcgggtggctcctgcagaagtggcagaagaggcgggaactaggaacctggcatcataggaaaagtgccttctccaagaaagaaggggccccaggaggctgtcttacttagatcaaccataaactaccacagatgggtcatttcttatattatttcaaaatatctttgaagatgagaattcatttgtgtccttcatagaccaaagttctttgtgttaccttttcccaaaagtaaattcctttccctttattcattccttgtggaaataaaatgcaagccctttatacttgtcttacagtaatatggcacatgtagcttacttttgagcatcccagtgaataatgtttggaacttttcttattacctaatagcatatagagaagagtgaagtcagctaaaaacagaaattttgaaaagccatcttcaggaaaatgtaggcccagatgctttcctccaccttttttgacaggctgccacatacagtttcacaggttgctaactgcacaggggcacagcctgtcctccatttgccaagtcacactttctggcacagagaggggtgtcttgttctaatttgtctttgtggcctgctctcttctgttcttgaagctgcaagccacagtgagatgagtgaaaagcagtcagtctcatagaaaaaagcagggaaaaagcaatagagacaagaaggaaagccaaggaaaggattcttggggaaggtcaacagggaagggtggagaaggggaaaggagatgaccattatgatcttctaattaggagtttaggggagatcgtttgccttattcagcaaccatgcgactagaaaataagcaatctctttaaaataatgctttactacagtcaacttcaataatcttttcgataattgggttgtgattaaacttacaggcacaagactaaataatcccaacgcctttaactttgcacattgttttttgtttgtttggttggttttgttgttttagtt

SEQ ID NO: 385520 - DNA, 2906 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagatgctgagaaattaggaatgaacaagtcagtcaagatcctgcctctcaggaagctgtattctagttgggggagaaagatgttggacaaatgaacacacagatgagcaagatgactgccagttgtgataagtgccaggaaggcaaaaaagtatgttgtgatagatagagctggctgatgtgaagaagatacatcagggaacaggacccagactcagatttggaaatcgtgatggtctttttcctgtttaacccccacagtgtagagcaatagcccccaaggttgggaggcacatgccttagaggttgcaagatgttcccttggagtacaggaagaaaatttcaatcttgtatttgtattaatatctaatttcatctcatcctttttaaagtatatgttttttaagacacataatatattagtagacttgtacataaatctaatttataaataaatatgcatatattggagatatta

SEQ ID NO: 385521 - DNA, 128 bp, Homo sapiens
taattctttcaaactatttcttcccaggtcccaggaacagcatggctccagcaaaggatgactcttctcttccagaatattcagcctttaacacatctgtccatgctgcaattagacatggaaattgg

SEQ ID NO: 385522 - DNA, 3718 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctcc

SEQ ID NO: 385523 - DNA, 3741 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctcc

SEQ ID NO: 385524 - DNA, 2900 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtactggcctgagtgctcgctgctgttgtagctaccaccaactttctactgaagatgataacccagggcataagaaatgacttcagacccaaggttctgaaagggcccctcaaggcctcgggtggctcctgcagaagtggcagaagaggcgggaactaggaacctggcatcataggaaaagtgccttctccaagaaagaaggggccccaggaggctgtcttacttagatcaaccataaactaccacagatgggtcatttcttatattatttcaaaatatctttgaagatgagaattcatttgtgtccttcatagaccaaagttctttgtgttaccttttcccaaaagtaaattcctttccctttattcattccttgtggaaataaaatgcaagcccttta

SEQ ID NO: 385525 - DNA, 3031 bp, Homo sapiens
taaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctcatggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttaactgcggtagccctaaacttacgggatcctctag

SEQ ID NO: 385526 - DNA, 475 bp, Homo sapiens
gcagtgctgttgctaagcctatatttagcaactgaaaatcatgctcagaaatactgtcatgcttttttaaaaaggcatatccatccctccacacatggctgattccagaaccttcatgcccttagcaaaaaattgagctgtccttcagggtttcaaaaaaagtactgtactcctgctgcaccccaggctcttggcaaggaggggacttttgtcctagagaatgttctttcttatgtattattgcaaaacaattttgttcttgcatactgaagcatcactggatgaatttctttcccctgtagacaaaccgagggtgagtattgctctttaaatgtcagtaaatttgttttagcttctggggcaaaccttgttgtatactcattctgttcctcccagcataatatgttaggttgtcataaaatagggcaaattgaggatagtgtaactactgctgctgaataaatgggaaatagtg

SEQ ID NO: 385527 - DNA, 1134 bp, Homo sapiens
cagggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacagggtatatttgaacaaactgtctgtcccaggcaggggctgggcagggcctgtgtgccttgctcagcctcctgacaggacacttttgttgcacttagaatttacattttaatggatgtaaaaacaactgtgagagatgtctgggcctgcagaagtccagcattgctcaaaaaagcgtgtgttctagtgaacattttcatatatatttattggttatagcctgttaaaatattttcttttttgtattatttatccccctacattatgtatttatatgagggaaaaaaaggaaaaaattgtacttttttagtatttacctgttacaaaggacattgtgtttcctgtcatgtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaattttatcttgtcctggtggtccaatttagatagcagagcaaggctgctgactgccaaatttcccccaagggaagaaggacaaggacaaggacactgaagacccttccctggcctttttgtccactgcccaggttcctgtctcccccttgatatgtcttaagtttaaataccattttctcactcataagagcctgtaacattttgccaacttcttcagctgtggtttaagtagcaagttgggaggtaacgggggactcttggatgctctctgtaggtttttctgtttggcctgtatgcctctaggt

SEQ ID NO: 385528 - DNA, 428 bp, Homo sapiens
gcctgtccctctccagcattcgtaaagtaacttcctgaagcaaacactggttgtcctataggcagcaattctgaagtcttcctacccatgctgcattgaaccagcaccaaatcctgctggtatgtgcaaaattctaagtaccagctgcctggtgacaggcccctgagctgagcctatttctcccttactgacccttgtgtgccagcatctcacctccattacacagatgggccagttcatactaatgcttgccgattgctgcctgcaatttgtctgtgcatgtggaggtgcaatttgttgtcattctctgtgcccaggttcatctgccagttgccaagaatatcaggcaactcagaggctcctggaagcatgaatgagaggaggctgagagggaagtctttggctatttccgaagtagagagaggatt

SEQ ID NO: 385529 - DNA, 675 bp, Homo sapiens
gacattgaaaagaggctcaactatagccagatagcctgcacccttaagcttgccatgtttacatgtcccagaaatcaacaggacagacgagactcttctaagatgctgtggaggggtgggatggaaggattgacaggagccatgtttgggtttctcttcccttctcagtatatatttcctaatatcaatatttctcaggggctataaacattttcttctttgtccagctcaagatacagattgaacttcaaacaaggtagaccagagacaattttttatttgaatgaataggaatgggtggactaaaataaaagggaaaaataatgtcttggattgtaactgttatcttagttgtgacaatacattgaggccatcttatctaacactgttggagtattataagggcaataagtttaatctcttccttataagtttggaagcaatggaaaggtgaaaatatcagctttattaccaataaagctgaactgaagaatgtggcttagatggtggccaataagctttttaatatttttccctgaattaaaattatttccagccaggcatggttgctcacacctgtaattccagcacttagggaggcagaggtgggaggattgcttgaatccaggagttaaagaccagcctgggcaacatagcaagaccctgttctccata

SEQ ID NO: 385530 - DNA, 903 bp, Homo sapiens
gcacccagccccatctgacttctatacccgcagccccttcctttaccctcaggctgcctcagtctccacactggggcccagagctgggctggactcagcgcagtcagaacctcgccttgcacgtggcgaaggagcggcaggcaggcaggcaggcaagcaggacagccagcttcctcctagtccgcagtcgcggagcagcctggaaagggaggcccaggcttccctgtctcgtcgcacgtgtgtctgcagtgtctgtgctatctcccaggggcctggatgtcgatggaatgcctgagggtggagagagctgtggctgaggcctaccctggtggcctcagcatctgtggagatgtgtagagacagggagagtgaatggggaccaacctcaggagatgctgggtcccagaagcaccatgtgcttctcctttggtgagacttaattactctctaaaatgtaaggctactcccacttatcaaattatagatgagtttaattacagcacactgagtaaccacactgggctccttcagaaatagcagcaggctggttgctcttctcagcttcagctgtagccaccccagtttcaggaggaagtgcccgtggttcctggggcctggaagtgccgctcaactctgctgccagacaagtgcgggcgtggtggactgcactgggtacactgctgtaccggccaccaccctccggccactctcagccggtgagtgctctgcggggccatctggccacgtgttctgtgactgggtcatttactctgctgcaacctctctttctcctacctacatcgtgttctggataaaggttttggctcataatgtccgaccagaggtggacaaagtggtgtgggacctgccgtaagaaacagggagcatggcgcggggagagaa

SEQ ID NO: 385531 - DNA, 494 bp, Homo sapiens
ttgttataggcaacagtgaaagatcaactgactctttcttggcttatttatattcaggaagcaggaagattgtgtgtaggtaaaggtggatatggtgattataaacttaggattgatttagattttggcaagttgcttctgtgggcttaatccattcaagcctgcctcccatgagacagcctgggctcaagggccagctgggtggaggagcaatcacgggatttgcaggaagcagacagctctgcctacctaggaaggctatccttcgcctctcagagcctatgagatagggataattctaaacctcatagtggttgttatctagataatgtgtggtaagctgtggggaaatgctttgttaactctgaagcattgcatgaaagatactttccatcatagaaatatagactgtttcataatcctagactattttagggaatctgggaaaaggaagatgtatttaactattttccttttctcttaattcctttgtg

SEQ ID NO: 385532 - DNA, 323 bp, Homo sapiens
ggggtttcaccatgttggtcaggctggtcttgaactcctgacctcatgatccgcccgccttggccttccaaagtgctaggattacaggtgtgagccaccgcgcctggccagttgtcattcttttcacctcacagagtcattgatcaatgagttagtatacgtaaaagtcctgaacaccttatggtgctgcacaaatgctaggcatattttaatgagtgactttcatttcacttagttgttgccttctgcccaaatgcagacttaaagttgagtgatttgaggcttatttcactcgtgcacaagccaacgtctcctgaacatgt

SEQ ID NO: 385533 - DNA, 263 bp, Homo sapiens
cctccctgtgtccatgtgttcttattgttcaactctcacttatgagtgagtacgtgccgtgaaaagcaaaaaattctaacttactattcaaaaatgagctgaaagacatgaagaaaaagacgcaaaacatgaaagaacacaaattagaactagaaaaactaagaaatgaggtgataacacatgaaagaattagaaataaagtaaaaaatctttcagaaaatgcagactaagctataaggaaataatagtgactaaatacaaca

SEQ ID NO: 385534 - DNA, 593 bp, Homo sapiens
attgtctggatgtaccacagtttattcatccttccacctactgaaggacatcttggtttcttctgatccctgtctttatttgaaattttgatattttgtttgcattaattgtgatgtttttaaaatttttcacttaaattttatttttcttgatcactaaatttttctggttccttgtaagttttgtgcatgaggcatgctctaatcctggccctggtcttacctctgtttgctcaatattcagaagcgagggaaaggcaggtgataccaagcatggagcagaatccaaaagacacagcccagtacaggtctgggcaccagggggctctgaagcacctttaggggagtccttggaaatactgatgggccccttcttccccattacctctgctgtcccctacatccctcactgcttctaagctcctcccctgtcctctcggctggatatccaatcttggatagcaatgccaagccctgtcttcccaagcagctgcttctgccacgtcttcctccttaagaatccacacagcccctcagtgccttctgcatctggtccaaactccttggcattggaggcccgtgctcagcctgcc

SEQ ID NO: 385535 - DNA, 595 bp, Homo sapiens
attgtctggatgtaccacagtttattcatccttccacctactgaaggacatcttggtttcttctgatccctgtctttatttgaaattttgatattttgtttgcattaattgtgatgttttttgtaagttttgtgcatgaggcatgctctaatcctggccctggtcttacctctgtttgctcaatattcagaagcgagggaaaggcaggtgataccaagcatggagcagaatccaaaagacacagcccagtacaggtctgggcaccagggggctctgaagcacctttaggggagtccttggaaatactgatgggccccttcttccccattacctctgctgtcccctacatccctcactgcttctaagctcctcccctgtcctctcggctggatatccaatcttggatagcaatgccaagccctgtcttcccaagcagctgcttctgccacgtcttcctccttttagtattcattccaccccttctcgcgccttcatgagttctcgtcccctcctttgtcattgtgagagcccttaccttatgactctccatctccttccacttggctctctacacacgcccttagtctcctcccct

SEQ ID NO: 385536 - DNA, 539 bp, Homo sapiens
attgtctggatgtaccacagtttattcatccttccacctactgaaggacatcttggtttcttctgatccctgtctttatttgaaattttgatattttgtttgcattaattgtgatgtttttaaaatttttcacttaaattttatttttcttgatcactaaatttttctggttccttgtaagttttgtgcatgaggcatgctctaatcctggccctggtcttacctctgtttgctcaatattcagaagcgagggaaaggcaggtgataccaagcatggagcagaatccagggagtccttggaaatactgatgggccccttcttccccattacctctgctgtcccctacatccctcactgcttctaagctcctcccctgtcctctcggctggatatccaatcttggatagcaatgccaagccctgtcttcccaagcagctgcttctgccacgtcttcctccttaagaatccacacagcccctcagtgccttctgcatctggtccaaactccttggcattggaggcccgtgctcagcctgcc

SEQ ID NO: 385537 - DNA, 5354 bp, Homo sapiens
ggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttcccccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttccctccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacaggcgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttc

SEQ ID NO: 385538 - DNA, 3402 bp, Homo sapiens
ccatgcttggctcagggcctggggcggggtcctgggtagagtcctagccccagagccccagcccctcatgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacaggcgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttc

SEQ ID NO: 385539 - DNA, 2233 bp, Homo sapiens
gccccacgctgtcgcaagaagtccccttctcgcccccaaaccagctcaaaatgccccctaggtgctgggggcgtggcctcaagttggggatgtgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttc

SEQ ID NO: 385540 - DNA, 3416 bp, Homo sapiens
acccaagtacccacctgcagctcatagcactcgggacccgcgtcggcgctcagcgtgaactggaagctctcattgtacttgggagcccagctattgttcttggatttggtgcaaacttgcgtttcttgtcgctgagctggggcccaatgatgttgacctcgatgaacggccggaagatgccagaagtctgccacttgaggtcattggcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacaggcgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttc

SEQ ID NO: 385541 - DNA, 1647 bp, Homo sapiens
gcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaagggatgcggccgacccttttccgatatatctttccgcccccactttactcc

SEQ ID NO: 385542 - DNA, 1888 bp, Homo sapiens
gcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaaaaaaaaaaaaaaaaaaaaaaaaaaatttggggggggcggggccctagaaaaaggtttcaaaacacctcccgggggggcgcgcgggggcgcccaagtaggtgtatgggaaccagctggggcgcaaaggcggggtccccaaaggggagaaaccgccgggccaaagacaccagacggggctggggtgttctccccccaaaataaaaaaaaaacggcgcggggggggacaccccggaggggtcctggaccaaacctccagaaggggaggtccagaggaggacaaaccggggctctactaaccgggggggccccacgggaaggccgagaaattaaaatagca

SEQ ID NO: 385543 - DNA, 1667 bp, Homo sapiens
cctagcgctgtgaaggattctgttctctgactttgggagggccagtgcagaagaatcaagacagaatatgctcccgtgtgggccaggctgtgaattctttgaaagaagctgcagagaagcaacaaagattatcctaagacttctggaggaagaattaggatccttctgcaggaactcagtttactgtgaattgaaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaaaaaaaaaaaaaaaaaaaaaaaaaaatttggggggggcggggccctagaaaaaggtttcaaaacacctcccgggggggcgcgcgggggcgcccaagtaggtgtatgggaaccagctggggcgcaaaggcggggtccccaaaggggagaaaccgccgggccaaagacaccagacggggctggggtgttctccccccaaaataaaaaaaaaacggcgcggggggggacaccccggaggggtcctggaccaaacctccagaaggggaggtccagaggaggacaaaccggggctctactaaccgggggggccccacgggaaggccgagaaattaaaatagca

SEQ ID NO: 385544 - DNA, 741 bp, Homo sapiens
agtatggaagcttttgtttaattcacctgtttttcacctgatttccatcagtcccaagttgatctcttacactctttctagagactagaccttagtctgctgctgaaaagaaagaagagagagaattggtaaaagggttttgagactctacttcataaacaagctttaaaccagttcttatatctacagcctatctttaccctcatttccagaagtacctggtgctgtcaattcctgtgctatttggagtttcaagatataaatcaggttatttcttggttttctccatggatagcttaggatttagctttctctgctctgtaaagctatccatcttactttctaagctttcaaatttttgttagtgttttctcttttcctattttgtctttgtatattgatgtcttttttatttttttactgccattggagagggttttcaggaaggagcagaggctaatgcatgcgtgtcacttactatctttaactgcaagttcaattctaattaatatctattccatttgcatcacaattgattcatgatctcagatgactcacagagattttacctacagctgttatctaggctcctttatctatttttccttcccggatattgtttagattccattggcttacatcgagtagagaacatcagccatacggaacctgctgtgagccttcacttgtacagtccaccttttgatacatgccatgcctttgatcaaagaacaggacata

SEQ ID NO: 385545 - DNA, 1933 bp, Homo sapiens
gcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaaaaaaaaaaaaaaaaaaaaaaaaaaatttggggggggcggggccctagaaaaaggtttcaaaacacctcccgggggggcgcgcgggggcgcccaagtaggtgtatgggaaccagctggggcgcaaaggcggggtccccaaaggggagaaaccgccgggccaaagacaccagacggggctggggtgttctccccccaaaataaaaaaaaaacggcgcggggggggacaccccggaggggtcctggaccaaacctccagaaggggaggtccagaggaggacaaaccggggctctactaaccgggggggccccacgggaaggccgagaaattaaaatagca

SEQ ID NO: 385546 - DNA, 1646 bp, Homo sapiens
gcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaacgggatgcggccgccccccccctctctttccctccccccctcgcggtctcc

SEQ ID NO: 385547 - DNA, 1893 bp, Homo sapiens
gcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaaaaaaaaaaaaaaaaaaaaaaaaaaatttggggggggcggggccctagaaaaaggtttcaaaacacctcccgggggggcgcgcgggggcgcccaagtaggtgtatgggaaccagctggggcgcaaaggcggggtccccaaaggggagaaaccgccgggccaaagacaccagacggggctggggtgttctccccccaaaataaaaaaaaaacggcgcggggggggacaccccggaggggtcctggaccaaacctccagaaggggaggtccagaggaggacaaaccggggctctactaaccgggggggccccacgggaaggccgagaaattaaaatagca

SEQ ID NO: 385548 - DNA, 1653 bp, Homo sapiens
gcttaaaaggggcccgggaggatgaaccccacagatctgaacctgatttgtgtgtgcaccgcgtctccagcgatcccggatccactgcgctgccaggggcctgggggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgatgcaggagtaggggtggagatggatagtgatcagggggaaggatgttgcaagtacaaggaagagcacaagtgaagattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaaaaaaaaaaaaaaaaaaaaaaaaaaaatttggggggggcggggccctagaaaaaggtttcaaaacacctcccgggggggcgcgcgggggcgcccaagtaggtgtatgggaaccagctggggcgcaaaggcggggtccccaaaggggagaaaccgccgggccaaagacaccagacggggctggggtgttctccccccaaaataaaaaaaaaacggcgcggggggggacaccccggaggggtcctggaccaaacctccagaaggggaggtccagaggaggacaaaccggggctctactaaccgggggggccccacgggaaggccgagaaattaaaatagca

SEQ ID NO: 385549 - DNA, 214 bp, Homo sapiens
tttgggcatctctcatggagagctctcccattcacgggcacctctgtgcaggtgggtttccaggagagcccagctgggagcacaattcgggagagtttcagagccctccttctgtgcccagcagagccactctaagatccactggcgctgggactgcgcccactcttggctgcctttccaggccattcagcagcccattgtttgccacagccac

SEQ ID NO: 385550 - DNA, 737 bp, Homo sapiens
tgtccactgaatgcttatcaggaatattaataacattaaacgaagttgttctcttcccgtaagattcatttaggatgcatattgtcaaactcatatttgagattaccaagactaattactagaatcttctgaattttataatagaatagggattatctgataacagaaataaactgtagaaagttgtatttaacctttggagaagagatttagacagtaaactctaagaattaaacatccacaagtacaatatacattagcaaaatctcattctaaaatgggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385551 - DNA, 299 bp, Homo sapiens
  misc_feature (71)..(71): n is a, c, g, or t
aatacacatattaaagattagaatatcaatatgcgcggacagcccccctccctcttgaccagcacactagnaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385552 - DNA, 279 bp, Homo sapiens
  misc_feature (39)..(39): n is a, c, g, or t
  misc_feature (47)..(47): n is a, c, g, or t
gctggggtgagggaagggtgctaggggaggggggggggngggttcanaggaaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385553 - DNA, 289 bp, Homo sapiens
tatatagcatgctttcattccgtgtttatttttatattcttgttttcttaaagggaactacaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385554 - DNA, 312 bp, Homo sapiens
  misc_feature (18)..(18): n is a, c, g, or t
  misc_feature (25)..(25): n is a, c, g, or t
  misc_feature (42)..(42): n is a, c, g, or t
ataacgcgcccacggccnggcgggngcccgcgccggagcccncgccccttaaccagtgtagggctcgcgtttgtttattcttcaaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385555 - DNA, 284 bp, Homo sapiens
aactgattcgtttactccataaaatatctgcaagagagagccttgagagaaaccagaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385556 - DNA, 461 bp, Homo sapiens
cacagggtgattgaatactgaatgcaaaacttgttctgaatgttagaaatcaccaagaatttcaaatccatatgttaaactttcaaaaagtggtttaagagatgcttttggggtatatcctccatgttgtgcacttgaaacattactatgttgcattgccatagcagggggatttaaatgtgagaattgagtgaggtaggtgcagtcattgtccccccctctgccttaagccatcaaacctgttattttgtgtgttatttttttctagaccaaagtttagaacttgtgtggagtcagcctataaatattaatgcaccatacctgaaaaaggaataagatacagattgaaaagaagaggctttctggtgaagtctaagagtttagaggatccacagtggaagctgtatctcaaaactcagaacgtttggaagaactcagtaggtatgataaatcaagtaaaa

SEQ ID NO: 385557 - DNA, 238 bp, Homo sapiens
  misc_feature (1)..(1): n is a, c, g, or t
  misc_feature (43)..(43): n is a, c, g, or t
ntcgttttatgtgaatcagcaggcaccctttgaaggctaatcnctcaaaactcagaacgttgggaagaactcagtttgtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385558 - DNA, 2190 bp, Homo sapiens
atgcctcgcctctctgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtatataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaaacctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattggattttgcatttcagtgtgttactataaatttaatccaaaacatctaaatccatgaaaataaaatatattccaattcttagaaatatcagcaatcatccatgaaataaatgatttcctcttatccactattccacaagaaatagtgataccatgaaaccaaaataagaaaatattttctaatgagaaaataattacaagcttaagaaaatctttcatgctgaattcatgtaggaaaatatttgctaaaactctagggaaacttctcaacatagataaaaggagtataagcaattaagcctaccatactgataagtcttgtttgaaacagttttctttacctgtgtaacagtatattttatgatacttttagctgatagcacataataaaacttat

SEQ ID NO: 385559 - DNA, 1796 bp, Homo sapiens
atgcctcgcctctctgtttccgtggagacgctctcggcgtcccctgtctccgctccggcggagccaggcttcggaatcactgagagaggagggggcagcgccaacgcccagcacctgccgccggtgggggactgacttcggcggaacggaaaactggagttgtttccctgggccagtgcaccgaggctgaagtctataagcctggagagaccatcagcagtaatctgcaaattccgaaatgaccaccctgcccccactgcccatgacacgcccgaagcttacagccttagccagacagaagctgccttgctcctccagaaaaattccaaggtctcaattgatcaaagaaaaagatgacatagatcattatctagaggtaaatttcaaaggattatcaaaagaggaagttgctgcttataggaactcctacaagaagaatatctgtgtggacatgctgcgagatggttatcataagtccttcaccgagctcttcgctctgatggagcggtgggatgccctgagggaggctgcgagagtcaggtccctcttctggctgcagaagcccctggaggagcagcctgataaactggattacctgtaccattacctgaccagggctgaggacgctgagaggaaagaatccttcgaagatgtatataataacttgtatgctctggcctgttacttcaataattctgaagacaagtgggtaaggaaccacttctatgaacgatgttttaagattgctcagctgatcaaaattgactgtgggaagaaagaagccgaggcacacatgcatatgggtcttctctacgaggaagatggtcagcttctggaagctgctgagcattatgaagcattccatcaattgacacaggggcggatatggaaggatgagacaggccgctctctcaacttgttggcctgtgagagtctcctgaggacttacagattactctcagacaaaatgctagaaaataaagaatacaaacaggccatcaaaattctaataaaagcttctgaaatagccaaagaaggaagtgacaaaaagatggaagcggaaacctcttactacttgggcttagcacacttagctgctgaggaatatgaaacagcattaacagtccttgacacttactgtaaaatctccacagacctggatgatgatctcagtctggggagaggctatgaagccatagccaaggtcctgcagagccaaggagagatgacagaagcaattaaatacttgaaaaaatttgtgaaaattgcaagaaacaattttcaaagcctagatttggtgagagcaagtacaatgcttggggacatctacaatgaaaaaggatactacaacaaagcttctgaatgctttcagcaagcttttgacacaacagtagagctaatgagcatgcctctgatggatgagacaaaagttcactatggaatagcaaaagctcatcagatgatgcttacagtgaacaactatatagagtctgcagatctcaccagcctcaactacctgctgtcatggaaggagagcagaggtaacattgaacctgatccagttactgaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385560 - DNA, 297 bp, Homo sapiens
  misc_feature (47)..(47): n is a, c, g, or t
  misc_feature (54)..(54): n is a, c, g, or t
atgggtgacgaacacacacgcgcgggggggcgggcgcggcggcgtcnggggggngtgcgggcgtctctaaagagtttagaggatccacagtggaagctgtatctcaaaactcagaacgtttggaagaactcagtaggtttccaggtgatcaaaaaaatgaaacttaaagcagcttttcacttaacatcaaagcaagaagaaatccatcatgtcaccttagacttcaatacttgtaataggagcatgttacagataatatagagttataataaaacggactatgactcttttcattgg

SEQ ID NO: 385561 - DNA, 1709 bp, Homo sapiens
gcaagggagcgacggcctgacgtcggcggagggaagccggcccaggctcggtgaggaggcaaggttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 385562 - DNA, 1773 bp, Homo sapiens
gcaagggagcgacggcctgacgtcggcggagggaagccggcccaggctcggtgaggaggcaagtcctgcagcctcagcatgcgctggccggatgtaccctgaggtgccctctcacttcctccttcaggttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 385563 - DNA, 1768 bp, Homo sapiens
gcaagggagcgacggcctgacgtcggcggagggaagccggcccaggctcggtgaggaggcaagaatccgggctttgcccctggtatcaagtcacggaagctccgggaatggcggccaggcacgttctgaggggacaggctgacgtggaggaacagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggtaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttca

SEQ ID NO: 385564 - DNA, 1800 bp, Homo sapiens
ggcacgaggtgggaagtgagcaatcagcacgtcccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385565 - DNA, 551 bp, Homo sapiens
gcacgagctgagcctgtcttgcagatcatccagtacctgtacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataattatgtgtgtctgagatgtgggggagccccactgttctataggggttgtgaggaggatcagtctctcctgccaccaggcacagatgagatcagtcatcttaggaaagcctggctgcacctgagaacctttatgaagtggttggagttgtctgaattcactgcctccacctcttcccaaatcaatcctattatcccac

SEQ ID NO: 385566 - DNA, 2520 bp, Homo sapiens
cgccaggcggcgccgtcggctgggcccggattcccctgcggcttcgatccctttccactgggtattgagattggcgaggggagaggcgcagaaacggcgtgatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385567 - DNA, 3493 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385568 - DNA, 3953 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggtgaggcctgggatgttcctcatctgttctcccagtaatcagcccatgttaccattacagcatcctcatgaatacctctattttaggcccccaaatccatgatcctgggtatcctccactctcatttcttacctaggcccctatgtctgccatcccaaacattgacttcagctttgtgatgaatctgttgaccactgtcaattttcctttaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtaggtgagcgggctgggtttccaggtgacagagctagggtgggcatgaaagaagcataatgaaccactcttttgtcctttgactagtcttagtcccaccttccatacctatccctcttccgttatccctcccttccccgattctggacagagtttgggtccttgacttccaggtacccccttttgtaatacctattcttgcctctgccccaatttatgtctctgacctgttccccttggcctctgaccttttctctgccaggtgtcccgatttcttcatacctactcagtgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385569 - DNA, 3159 bp, Homo sapiens
caaaaatatgtagaggcggccgctgtgtaaattatatctgcctgggttcatttaatcgattgctggcgtcgtttaacccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385570 - DNA, 2671 bp, Homo sapiens
ggacgcgtgggtcgcccacgcgtccgagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385571 - DNA, 2803 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385572 - DNA, 230 bp, Homo sapiens
ctccgggatgcgcctcagcacttctatgcagcactgctgcagctgggcctcaagtacctctttatccttggtattcaggtgggtgtaggagagagatcagggagttggtgttttttctctgtgtgtgcatcactttctttcagaccttcaaaaccgtgggagagagccttgactgagtttcacataagtgaagtggttgcccaagcccagtggcctcaaatggcagttct

SEQ ID NO: 385573 - DNA, 520 bp, Homo sapiens
tcttttttctttttgagaaaaatatttatccgtttctactcctgacacatttattggcccccaggggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggtgaggcctgggatgttcctcatctgttctcccagtaatcagcccatgttaccattacagcatcctcatgaatacctctattttaggcccccaaatccatgatcctgggtatcctccactctcatttcttacctaggcccctatgtctgccatcccaaacattgacttcagctttgtgatgaatctgttgaccactgtcaattttcctttaggagccagaggtgattcctcaagttagccttgtgcccacgctggccctgctgctgggcctgcccatcccatttgggaatatcggg

SEQ ID NO: 385574 - DNA, 2457 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385575 - DNA, 2543 bp, Homo sapiens
aacggcgtctccctctgttgtccagactctagtgcagtggttcaatctcggctcactgcaacctccgcctccccgattcaagcgattctcctgcgtcagcctccccagtagctgagactacaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctgagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385576 - DNA, 3708 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385577 - DNA, 3906 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatataattatgtgtgtctgagatgtgggggagccccactgttctataggggttgtgaggaggatcagtctctcctgccaccaggcacagatgagatcagtcatcttaggaaagcctggctgcacctgagaacctttatgaagtggttggagttgtctgaattcactgcctccacctcttcccaaatcaatcctattatcccac

SEQ ID NO: 385578 - DNA, 3920 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggtgaggcctgggatgttcctcatctgttctcccagtaatcagcccatgttaccattacagcatcctcatgaatacctctattttaggcccccaaatccatgatcctgggtatcctccactctcatttcttacctaggcccctatgtctgccatcccaaacattgacttcagctttgtgatgaatctgttgaccactgtcaattttcctttaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtccttttactgtgccatggcaggcagtctcggcttgggccctcatggccacacagaccttctactccacaggccaccagcctgtctttccagccatccattggcatgcagccttcgtgggattcccagagggtcatggctcctgtacttggctgcctgctttgctagtgggagccaacacctttgcctcccacctcctctttgcagtaggttgcccactgctcctgctctggcctttcctgtgtgagagtcaagggctgcggaagagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385579 - DNA, 3000 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgacttggattatgtggtccctcaaatctaccgacacatgcaggaggagttccggggccggttagagaggaccaaatctcagggtcccctgactgtggctgcttatcagttggggagtgtctactcagctgctatggtcacagccctcaccctgttggccttcccacttctgctgttgcatgcggagcgcatcagccttgtgttcctgcttctgtttctgcagagcttccttctcctacatctgcttgctgctgggatacccgtcaccacccctggtaaatatctcagctctgattcacttaaagacaatagtgatgtgagttcggcccctcttgttttcaaggaggtgttgctcctcatgttcctgagcttgacagagggtcccatgccccacacaactaggaaggtcttcttggtgtcctctctcttacctgccatagccaagcaaattgatccctcctgttggttcccagggttcatggagaggagagacaaggagtcctctaagactccctgtggaaatgctgcatcctcatgagcacatttcttgattttccagtgatggaagtagtaaattgtgaatatataat

SEQ ID NO: 385580 - DNA, 2555 bp, Homo sapiens
ggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctctaccgatctcaggttgaccctcctaccaccaccatgcagcgcctcaaggccctcaccactggctcactgcctacctttattgatgctggtagtaacttcgccagccacgccatagtggaagacaatctcattaagcagctcaccagtgcaggaaggcgtgtagtcttcatgggagatgatacctggaaagaccttttccctggtgctttctccaaagctttcttcttcccatccttcaatgtcagagacctagacacagtggacaatggcatcctggaacacctctaccccaccatggacagtggtgaatgggacgtgctgattgctcacttcctgggtgtggaccactgtggccacaagcatggccctcaccaccctgaaatggccaagaaacttagccagatggaccaggtgatccagggacttgtggagcgtctggagaatgacacactgctggtagtggctggggaccatgggatgaccacaaatggagaccatggaggggacagtgagctggaggtctcagctgctctctttctgtatagccccacagcagtcttccccagcaccccaccagaggagccagaggtgattcctcaagttagccttgtgcccacgctggccctgctgctgggcctgcccatcccatttgggaatatcggggaagtgatggctgagctattctcagggggtgaggactcccagccccactcctctgctttagcccaagcctcagctctccatctcaatgctcagcaggtgtcccgatttcttcatacctactcagctgctactcaggaccttcaagctaaggagcttcatcagctgcagaacctcttctccaaggcctctgctgactaccagtggcttctccagagccccaagggggctgaggcgacactgccgactgtgattgctgagctgcagcagttcctgcggggagctcgggccatgtgcatcgagtcttgggctcgtttctctctggtccgcatggcggggggtactgctctcttggctgcttcctgctttatctgcctgctggcatctcagtgggcaatatccccaggctttccattctgccctctactcctgacacctgtggcctggggcctggttggggccatagcgtatgctggactcctgggaactattgagctgaagctagatctagtgcttctaggggctgtggctgcagtgagctcattcctcccttttctgtggaaagcctgggctggctgggggtccaagaggcccctggcaaccctgtttcccatccctgggcccgtcctgttactcctgctgtttcgcttggctgtgttcttctctgatagttttgttgtagctgaggccagggccacccccttccttttgggctcattcatcctgctcctggttgtccagcttcactgggagggccagctgcttccacctaagctactcacaatgccccgccttggcacttcagccacaacaaaccccccacggcacaatggtgcatatgccctgaggcttggaattgggttgcttttatgtacaaggctagctgggctttttcatcgttgccctgaagagacacctgtttgccactcctctccctggctgagtcctctggcatccatggtgggtggtcgagccaagaatttgtggtatggagcttgtgtggcggcgctggtggccctgttagctgccgtgcgcttgtggcttcgccgctatggtaatctcaagagccccgagccacccatgctctttgtgcgctggggactgcccctaatggcattgggtactgctgcctactgggcattggcgtcgggggcagatgaggctcccccccgtctccgggtcctggtctctggggcatccatggtgctgcctcgggctgtagcagggctggctgcttcagggctcgcgctgctgctctggaagcctgtgacagtgctggtgaaggctggggcaggcgctccaaggaccaggactgtcctcactcccttctcaggcccccccacttctcaagctgagtgacttgcacctataatcccagcactttgggaggcagaggtgggaggattgcttggtcccaggagttcaagaccagcctgtggaacataacaagaccccgtctctactatttaaaaaaaagtgtaataaaatgataatata

SEQ ID NO: 385581 - DNA, 1987 bp, Homo sapiens
gtacatggtggtggcaagagaaaatgaagaagaagcaaaagtggaaacccctgataaacccatcagatcctcatgagaccttactatcatgagaaatagcacaggaaagactggcccccccctgattcgatgaccctccccccgggtcccctccccacaacatgtgggaattcccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactgga

SEQ ID NO: 385582 - DNA, 1933 bp, Homo sapiens
gtacatggtggtggcaagagaaaatgaagaagaagcaaaagtggaaacccctgataaacccatcagatcctcatgagaccttactatcatgagaaatagcacaggaaagactggcccccccctgattcgatgaccctccccccgggtcccctccccacaacatgtgggaattcccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactgga

SEQ ID NO: 385583 - DNA, 2081 bp, Homo sapiens
gtacatggtggtggcaagagaaaatgaagaagaagcaaaagtggaaacccctgataaacccatcagatcctcatgagaccttactatcatgagaaatagcacaggaaagactggcccccccctgattcgatgaccctccccccgggtcccctccccacaacatgtgggaattcccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggaaaaaaaagaacctcaactcgagggggggcccggacccaatttgccctataggagtggattacaattactgggccgcgtttacacgtcgggtggg

SEQ ID NO: 385584 - DNA, 1957 bp, Homo sapiens
gtacatggtggtggcaagagaaaatgaagaagaagcaaaagtggaaacccctgataaacccatcagatcctcatgagaccttactatcatgagaaatagcacaggaaagactggcccccccctgattcgatgaccctccccccgggtcccctccccacaacatgtgggaattcccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactgga

SEQ ID NO: 385585 - DNA, 2064 bp, Homo sapiens
gtacatggtggtggcaagagaaaatgaagaagaagcaaaagtggaaacccctgataaacccatcagatcctcatgagaccttactatcatgagaaatagcacaggaaagactggcccccccctgattcgatgaccctccccccgggtcccctccccacaacatgtgggaattcccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggagatttttggtactcttataaagcaaaattgtttgttatacatacagatgaaataagaaaataatgtaatctttctgt

SEQ ID NO: 385586 - DNA, 426 bp, Homo sapiens
actttctgtctctatgaagttgtctactctagtaacctcatataagtgaaatcacgtatttgtctttctgtgactggcttatttcacttagcataatgtcctcaatgtttatccatgttatagcatgtgtcacaatttccttcctttaaaaaaattgaataatgtcccattgtgtttatatgccacattttgtatatccattcattcattcgatacttgggttgcttccaccttttgtcttgcccttgtttttgagaggttaatccatctatgaggtcctccaggcatcaaaagagttccccagttccctactttggagaagttcactatccctagcaaagatgcaaagaacagatacatgaaaaagtaaatcatggtgcaaaagttgtatgagacaacactttaagatgtatcctatgagcgtag

SEQ ID NO: 385587 - DNA, 908 bp, Homo sapiens
tgaaagaggatggcaatctcgctgaagctgtttctttttcttcacaacatataggaaagtgttgcccctttttggagaaagtaacaacctccaccaacactacttgaatcagtactgaacgaatgtcaggtccttgggaaattctccaatcctgtctcctgtcctggccgggtgtgctcctggtgcaccattcgactaagtcaatttgaactatttgggagacctttgtacctacgtttccttctgcttggaagatcctttctgttttgtcagctcttacttccatgttgtggaaaactgatctgacctcctagtcctgaatcaggggccataaagaaaattgatgaggacaactggcctcccagtatgtggattcagtttccatatgtcaatttaccaactcccactggtagtctgaagagatatggctactggagaacagaaaatcaccagtattaataaaagcaattttaagtgtttaccttttagtatttgaatagctttgttaaagagacgtactcaagaatactatgaagagactcttattgtactccttacctggagataattgtgatgccagaaattcaaatttatattcaacaatatggtttttcaaccatcaatattataaacatctaggcagtgtctattgtttgcgcatttgccatcctctaaaatgagattattctaagcataaattatacttcatcattcaagattataaacatttataataatcataatattcacagacatttccctgctctcaaatcactagagctaataggcaaagtagatacagctacaaacagtgggagaaaatatttctggctgacctacaaatagctgtgcaataatgtagagaggaaaatatagtctcacttacagtgtctgaaattgagtttccc

SEQ ID NO: 385588 - DNA, 191 bp, Homo sapiens
ggaaagagttatttcatggaaagcctttagcttttttctgtgaaaactaaggacaattaaatgtaggtaagttagactgtaaatagccattgtaataatagtatacaattttattttattcacaagttctatattatttaataatgtcatacattgcatttattaaataaaaattaatctggttcctgtga

SEQ ID NO: 385589 - DNA, 3244 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385590 - DNA, 690 bp, Homo sapiens
ggatggtggctgcaggatgggttggggaacatgggaggctgggagctgaggctactgggtgctcatgatctctcctctctcctcagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccaagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385591 - DNA, 286 bp, Homo sapiens
ggatggtggctgcaggatgggttggggaacatgggaggctgggagctgaggctactgggtgctcatgatctctcctctctcctcagtacggcaagaagaagctgaaatacctgccctacaatcaccagcacgaatacttcttcctgattgggccgccgctgctcatccccatgtatttccagtaccagatcatcatgaccatgatcgtccataagaactgggtggtgagttggggacacagctggcttggcatggggaggagggtgactgggacagggggacccgg

SEQ ID NO: 385592 - DNA, 3582 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagctctggttccacacctggtgacggagaggcagagactggctgccacacctgctggagcgctcaccgtgtggtccctcagcagcacgcctcatctgccaccatcgtcttatgatcagggaaactgaagcctagagagataaagtgacttcactccatctggggctggcgcatgctctgagctcagtcatggcagggctggattctggccttgtgggggcctgaagtgctatccccgagggttgaaggttccgggaactgctcctaagaagggcctgttacaagcgagctcggttccctggtggcttgcatggctcatccccacccctctctccccacagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385593 - DNA, 3604 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtgaggggtggaggtccacaggcgctgggccctgggatcacccgtggtgcagacagtgggatcacaagaggggctgggccctcctggcacagtcacccaccagggcacctgccttactcccgagcctgtgttaggagctgttgggcttttctccctgggctgcgagaagaccatccctttctgtgtggggttcctggtgggctctgagctgacagccccacaggcccagtggcagtggtaagccctggttagggccaaggggacatacatgccaccttaatgatggcctcctcagcccttgcactccctggggccactcccgtcctggtccctgaccctggtccatccccaactttgcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385594 - DNA, 3055 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagtgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385595 - DNA, 1560 bp, Homo sapiens
tcgcccctgttatctgaccatcttcaaggtacagggaactgatctgggctccctcctacttgtgtcccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385596 - DNA, 2940 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctccccttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385597 - DNA, 1796 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggttgtatgcccccgacccccgcagaggcagaatgaacccatagggagctgatcgtaatgtttatcatgttacttccccacccctacattttttgaaataaaataaggaattttattctca

SEQ ID NO: 385598 - DNA, 2163 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacagaaagtgaaaggccccacagcccccccgtgtggaaacccaaaaaccccccgggggttgggggaaggggtgcaggtggcggtgaatgtgccacgagggaaatgactgtggcttttgttctgaagtggggggtttggttcccccggaacggaatggggcctttgggggttgggttaaattttgggccacaaacctttggggtctttttccccaaaaacccggggggggaaaagcacaacacacaaaacacgacagaccggagagaaacactttttggcgttttggggcatcctttttcattccccctttttcttcccttcttccgtttttttccgtctttcgaccattcttcgccgccattaggcagcgcccttttgggttggggggttgccccaccacgcagatcaaccccgacgagcagcttggcattttctttttcttttccacgccaaaaattcttttggtgtgctgttgggataaaaaaaaacccgccctttgttggggtgcaccccgccctgttttacaccgcaccttgttcaaaaggggacccgggtacaagagcgcaatttcctcaaatgggccgcccaaag

SEQ ID NO: 385599 - DNA, 1902 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacagtgagcgcggggctgcggggaggcggggagacccacagcgggagggaagtggccgctatcccactgggcagaatgcagaatgtgggggccacctctttgtctctctgacaaggtctctgcccaatatagagcaaggctcccagccagccccgctgaggtcaggagaggggctcccctattccatctccctgagggtcatcctgtgcccctcatgctgtgccacttggtcatagtggttaccacctccctccatgtgggcctgggactttgtagttatggagcctgcacacgcacctcatgaccctgtgaggctagcagggcagggctacgtagcttgcctggaacatcggccgagggactgccctgctgccccttgtccttgcttcacctcttgtcactgttttttttttttttattaaaaaataaaaaatgtagagacagagtctcaccctgtttccttgcactccagcctgggcaacagagcaagactccatctca

SEQ ID NO: 385600 - DNA, 1273 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgaggccagctgtggtggctcacacctgtaatcccagcgctttgggaggctgaagtgggagaagtgcttgagcccaggagttcaagaccagcctgggctacatagtgagaccccatctctgcgaaaaatacaaaagattagccaggtgtagtggtgtgcgtctgtggtcccaggtgcaggggaggctgaggtgggggaatcacttgagcctgggagcctcaaggctgcaatgagctatgattgcaccactgcactccagcggggacagaagagggagactctgtctca

SEQ ID NO: 385601 - DNA, 1312 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagcgatggagtttcactcttgctgctcaggctggagtgtagtggcgtggtctcagctgattgcagcctccgcctcctgtgtctttgtgttgacaaacctctaatcttccatgtctttgtgttgacaaacctaaccttccatgtctttttgttgacaaacctctaaccttccatgtctttgtgttgacaaacctctccatgggtggtgcatctgaccctatcccaacatgccttaggacgctcatctccttgactgtctgccatcccctcccaaaactaagtggaggctctgtcttttcctcctagtttgaggttctcttctcccagtgtctaaaatgatcaatatgcctagagtagatgctgctgaagaggcaaagtagtaatcctgccacctggaagcaaaggctgtgggttggagggggaagcgggtgtgagggctgatgataagccct

SEQ ID NO: 385602 - DNA, 608 bp, Homo sapiens
gggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctcacacttcctgtgtttcctgcacgccaatgccaggccatggtattgggtgatagatgaggcccttctagctgggcctgggcaccaggaggggtccccatgcttgcatctctctgtatcccctccctcccctgtggccatcccacccgcctctccctgctgcctctgaaattcattctggggcccggaacttgg

SEQ ID NO: 385603 - DNA, 2942 bp, Homo sapiens
gcagatggaatgcacggcagggaggcgggaccctttgtttgtgtgtgcgtgttgttggcctccatccccactccccagactccacttctccaggcctctctcccgccttttcatcccgcatccgcaggacacccaatcaccgggcaacaggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385604 - DNA, 3333 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctcaaaaaaaaaaggataaacaaaaaaaaggggggccccataaaatttggtgcgcacagcactatgggacaaaaggggcacacccaccattag

SEQ ID NO: 385605 - DNA, 3148 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgtagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385606 - DNA, 1775 bp, Homo sapiens
ctgtacggtcccgagtgttgtgattagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccaggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385607 - DNA, 2241 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacctcttccccaccatgccccggcacaacttacacaagatcgccccgctggtgaagtctctatgtgccaagcatggcattgaataccaggagaagccgctactgagggccctgctggacatcatcaggtccctgaagaagtctgggaagctgtggctggacgcctaccttcacaaatgaagccacagcccccgggacaccgtggggaaggggtgcaggtggggtgatggccagaggaatgatgggcttttgttctgaggggtgtccgagaggctggtgtatgcactgctcacggaccccatgttggatctttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagctgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatagggagctgatcgtaatgtttatcatgttacttccccacccctacattttttgaaataaaataaggaattttattctca

SEQ ID NO: 385608 - DNA, 1863 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacagtgagcgcggggctgcggggaggcggggagacccacagcgggagggaagtggccgctatcccactgggcagaatgcagaatgtgggggccacctctttgtctctctgacaaggtctctgcccaatatagagcaaggctcccagccagccccgctgaggtcaggagaggggctcccctattccatctccctgagggtcatcctgtgcccctcatgctgtgccacttggtcatagtggttaccacctccctccatgtgggcctgggactttgtagttatggagcctgcacacgcacctcatgaccctgtgaggctagcagggcagggctacgtagcttgcctggaacatcggccgagggactgccctgctgccccttgtccttgcttcacctcttgtcactgttttttttttttttattaaaaaataaaaaatgtagagacagagtctcaccctgtttcct

SEQ ID NO: 385609 - DNA, 1956 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagtacggcaagaagaagctgaaatacctgccctacaatcaccagcacgaatacttcttcctgattgggccgccgctgctcatccccatgtatttccagtaccagatcatcatgaccatgatcgtccataagaactgggtggacctggcctgggccgtcagctactacatccggttcttcatcacctacatccctttctacggcatcctgggagccctccttttcctcaacttcatcaggttcctggagagccactggtttgtgtgggtcacacagatgaatcacatcgtcatggagattgaccaggaggcctaccgtgactggttcagtagccagctgacagccacctgcaacgtggagcagtccttcttcaacgactggttcagtggacaccttaacttccagattgagcaccacagtgagcgcggggctgcggggaggcggggagacccacagcgggagggaagtggccgctatcccactgggcagaatgcagaatgtgggggccacctctttgtctctctgacaaggtctctgcccaatatagagcaaggctcccagccagccccgctgaggtcaggagaggggctcccctattccatctccctgagggtcatcctgtgcccctcatgctgtgccacttggtcatagtggttaccacctccctccatgtgggcctgggactttgtagttatggagcctgcacacgcacctcatgaccctgtgaggctagcagggcagggctacgtagcttgcctggaacatcggccgagggactgccctgctgccccttgtccttgcttcacctcttgtcactgttttttttttttttattaaaaaataaaaaatgtagagacagagtctcaccctgtttcctgttgcagtgagccaagatcgctcactccagcctagcgacagagtgagactccatctcaaataaataaataaattaattaattaaattaaatta

SEQ ID NO: 385610 - DNA, 1454 bp, Homo sapiens
gcggaggaaggggaccgcttgggggcactgggaagccagggatcctccgccaggaaggcagggacactcccgagcgcaggcgagaaggctgggggagggggcgcggtgggaggagtaggagaagacaaaagccgaaagcgaagagggcccgggctgcacacaccggctgggaggcagccgtctgtgcagcgagcagccggcgcggggaggccgcagtgcacggggcgtcacagtcggcaggcagcatggggaagggagggaaccagggcgagggggccgccgagcgcgaggtgtcggtgcccaccttcagctgggaggagattcagaagcataacctgcgcaccgacaggtggctggtcattgaccgcaaggtttacaacatcaccaaatggtccatccagcacccggggggccagcgggtcatcgggcactacgctggagaagatgcaacggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaatggctggattcctaccctcatcacggcctttgtccttgctacctctcaggcccaagctggatggctgcaacatgattatggccacctgtctgtctacagaaaacccaagtggaaccaccttgtccacaaattcgtcattggccacttaaagggtgcctctgccaactggtggaatcatcgccacttccagcaccacgccaagcctaacatcttccacaaggatcccgatgtgaacatgctgcacgtgtttgttctgggcgaatggcagcccatcgagggtagagggaaatcttgttccagttcagcaggaaggcaagatttcaggggctcaagcttggtcgccaaccgactagctcatgttgagaaaaccttatttggagaatcatcatcctgtacactgggaggagcctcaacgtggcttggtccaatctgcttcaccagtggataagaaattgaaggccagctgtggtggctcacacctgtaatcccagcgctttgggaggctgaagtgggagaagtgcttgagcccaggagttcaagaccagcctgggctacatagtgagaccccatctctgcgaaaaatacaaaagattagccaggtgtagtggtgtgcgtctgtggtcccaggtgcaggggaggctgaggtgggggaatcacttgagcctgggagcctcaaggctgcaatgagctatgattgcaccactgcactccagcggggacagaagagggagactctgtctca

SEQ ID NO: 385611 - DNA, 651 bp, Homo sapiens
tcaacttgaaataatttcacttacaaaatagctggaaaaatagtaaagataattcctgtattttgttcacccacgtattccaaatgtgtaacactacaatcagcaaaatcagcacattaatattattacctaatctacagacctcattcacattttgccagttgttctgctggtgtgctgtatgtagtgcaggatccagtctaggcccgtatgttgcattttgctgtcatgtcttcttagtctcctttcatctcagtggtcttttcttttccatgactatgacagaaatgatttgtatccttcatatatctgcagtcacatgaagtctatttgtcccactactggtgacgtaaattttggtaacttggttgagggtggtaccgtctaggtttctccatattaagttgctatttttccttgtgtatttaataagtatcttatagggaaatcctttgagactatgtaaatatcatattacatgtattttgcctgttttagcatcttttgaagataattgcctgaaacattttttactgtgatgattttctaattctatcattctgcatttattagtttggaattcgattgtaaggaattatattcccttgtttcctattattttattaaagaaatttacatccaaatagtgtg

SEQ ID NO: 385612 - DNA, 904 bp, Homo sapiens
ccaaattagacaggaaaaagtcaaatcaattgttgggcgaaaatttatcggttggtttaatagctctgcacaaagacagcctgacttgaatgtctatattacacatacactgttatttgaaacactctgctttagtacagatggtggttgatgcgtttatcctgccattagcaccaattgggagaaattttactacagcattttaaataatcacaagagtaaatagatttctattattttatctaataacaacaatagaatatagaatacaaaggacttcctctagatacattttattttatctaataacaacaatggaatatagaatacaaaggacttcctttagatacattttccacaaattatctgcttatttaaatacaaagggtttaatatctatgaaggtaataactcaccgtgtttaaaggatttatttcttcatctcagaggtagtcttcaagtatttgcagttaaacagtatgcaaatagccctttgcttacacaattatccaggtaaaaagactatgtcaggtgttgagatttctttgaattttctaagagttttcattatttacgcctttgtcagattaattttaaaggcaactcttgactgttagcttggtgtgaagagatccactcaggcagctcatgtctcctaagtgccctcagacagcagtgacgggacacttcacatgacgctagcatgttggctccgtccgcatggcggaatgcattccctgctgttagttatctgaatttttctcctgaattacaaatatatggatttggctcccctgatgctgggcttctgctgagacctgttccagtacattcacgtatgctttgctccccttcattgttaagaaattaattcaagaaggtttttgctgttaaacataaggaa

SEQ ID NO: 385613 - DNA, 850 bp, Homo sapiens
ccaaattagacaggaaaaagtcaaatcaattgttgggcgaaaatttatcggttggtttaatagctctgcacaaagacagcctgacttgaatgtctatattacacatacactgttatttgaaacactctgctttagtaactacagcattttaaataatcacaagagtaaatagatttctattattttatctaataacaacaatagaatatagaatacaaaggacttcctctagatacattttattttatctaataacaacaatggaatatagaatacaaaggacttcctttagatacattttccacaaattatctgcttatttaaatacaaagggtttaatatctatgaaggtaataactcaccgtgtttaaaggatttatttcttcatctcagaggtagtcttcaagtatttgcagttaaacagtatgcaaatagccctttgcttacacaattatccaggtaaaaagactatgtcaggtgttgagatttctttgaattttctaagagttttcattatttacgcctttgtcagattaattttaaaggcaactcttgactgttagcttggtgtgaagagatccactcaggcagctcatgtctcctaagtgccctcagacagcagtgacgggacacttcacatgacgctagcatgttggctccgtccgcatggcggaatgcattccctgctgttagttatctgaatttttctcctgaattacaaatatatggatttggctcccctgatgctgggcttctgctgagacctgttccagtacattcacgtatgctttgctccccttcattgttaagaaattaattcaagaaggtttttgctgttaaacataaggaa

SEQ ID NO: 385614 - DNA, 314 bp, Homo sapiens
ttcctttttataaaaatgaataacctcccaaacagattaaacattattgacagatttgcttccatctaatagaaaatgtagcatgatagtcaagcagcatgcctcaagcatgatggtcttggatgaccagcataagaatcaccttggaacttattgaaaatatagtgatttacatcccattcaaaatctactgaatcaaaatattcattttaacaaactcttcagataatttatttgcacattaaagtttaagaaacacagtactaaagcaattcattatcaccaactgtataagaacccgtatgtgtttgtgt

SEQ ID NO: 385615 - DNA, 991 bp, Homo sapiens
ttcattatctttataaatatagctcacactttagtgtttaatatagagtagttatgcttcaagtaaggtatatgtccttatcatgaaattgattctaggccattttttttcttgctctgttttcctctacgtacttcttgtattgtgtgcttgcctatatgattcagttttctgttagctattgttaaagaaaaaaaatttatgaacatgttgaacattcaagcaatataaaaggatatgcagtgacagtgtaataaggttattattactatggttattactatgaataggttcttgtggatacttctgacagtttttgtgcatatgtcaacatatgtatgaagatatcctcattttaaaaaaccacatgaaggggagcctgttacatgtatttctctaccttgagttttacacttaacacatagtgtctcacattgttggtatccaacaaatacttattgaataattaaaaaataatacatctatagcaatgtttacagtcagcatatacattccagctccttcttttggtagataatagatccatataactgtattttgtaatatagatgtgctctaattcattggctatgtcccctaaggaaacacacatagattgttttgtagtctttctattacaaacaattctttaatgaatctctttggctattttgagtctcttgcattttcaaaacaattttaggataagcttgtcgacgttcacaaaaagctgattaggattttgatagggattttgttgaatctgtatatcaatttaggaagtgttgtcctcttaacaaaattaagctttccagtccatgaacatataatgtctttttgtttacttaggtctttaatttcttaatgatgtttcatagttttcaatttataagtcttgtacttcttttattaaatgtattagtattcttttcaatatgattataaacagaattgttttcttaatttcattttcatcttaatgtatatcttt

SEQ ID NO: 385616 - DNA, 270 bp, Homo sapiens
ttcccatggtattcacaaggctcacaccccaccttttcatacataaatcaccccctttatttcacatgaacatctttgttgtattttgcagaaagttacccttactgaaacacagaggacgctctgttggtagctttggaaatggcccttggggctccagctgggagcatctcatgttcttgttcctacgtagttactttctggggatagtcacacatgttgaatgttggcagggaagagttaccctagtccaacactttcatttgccaa

SEQ ID NO: 385617 - DNA, 437 bp, Homo sapiens
aaaataggagtttttaggaaagcggctaaacagctttaagaaaaagtaaatgaggtcaaacctgttcaaccaggcccttgtgcattaagtagctcaaatagagggcaactgattaaccatttgacacttcacacacctgcaaagttgacctgaccaggctggctccagccaattttgcaatcattttctcgccacccattccctatttcacatcagcccccctcccccacttcaggctccttggccacctccctcctctccacttacacaacctgaattcatctgtaccaaaatattcacccctctctgacttctttttttgggttttatgaggcaggtggtctgagaaattgcttatgactgttggtcctaattatgaagctaattcattcagactatggaatacttagaaaacacaaagtgcaaagaaaaaacaa

SEQ ID NO: 385618 - DNA, 322 bp, Homo sapiens
agctgacgccatgcttgtacagcctgcacaactatcagctaattaagcctcttttctttataaattatacggccccgggtgtttacagcaatgcaagaacaacctaatatagtcatgctagcaaaaattaaaaactacgtagttaatgaaacatagaaaataaaatttctaatgatttgtaaaatgttagcagggatgagttgtaccttggtaaattgatataaataaacattatctgactaattcactctttgtttgataagaactatctttaagaaactgataataatgaggcaagaaaatttctattaaaataacaata

SEQ ID NO: 385619 - DNA, 361 bp, Homo sapiens
  misc_feature (299)..(299): n is a, c, g, or t
cgtggcacaccaacacaaaggaacattattcaaccctgaaaaggaatgaagtgccgttacggattcgtgctacaatgtggatgaatgctggctaagtggaagaagccacacacagaccaccacctactgtgtgattccatctacacactgagcatcccaaatccaaaaagctgaaatccaaaatgctcccaaatcctaaactttttcagtgccaacatggtgctcaaaggaaatgcacactggcacattttttcttttttttttttttgaggcagagtctcactctgtcccccaggctnggagtgcagtggcacgatctcggctcactccagcctctgcctcccaggttcaagcaatcctc

SEQ ID NO: 385620 - DNA, 140 bp, Homo sapiens
tgaaaggagctataccaaggttctctgtcattagcaacgcctacccaggatccacaactaagaaaaccacacagggagcaatgagcctttcaagaagccacagggttcagaaactgttgagttttaaacaggtagtaatt

SEQ ID NO: 385621 - DNA, 4097 bp, Homo sapiens
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385622 - DNA, 4149 bp, Homo sapiens
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtacagtgaagatggcattgaagggtgatgctggtctctcggattatgaaggtgcagaaagaatcggaaagagaaagtttgctgtctttggggataaactactagagaattgcgtcagaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385623 - DNA, 3710 bp, Homo sapiens
gttgcgctgtcgtgaaagaacagcgggggcgcctagcatttgctgaggagtcggagttgtgagagtgaagatagcattgaaggtgatgcttgtctctcgcgagacatgatatgtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385624 - DNA, 4334 bp, Homo sapiens
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccacgtgagttttttcttactgttggggtacttttcttggcagggtgaagtgaagtaagataccaggctcctggctcctgaatttctcttctgacctcttatagtggttatcaaacattgtctggttgctgttttcttcgcatggaatattgagaacatcttttaaagggcttggggaacaaggagacttgtccatgtgaagagtaagggtttatgagagtcccaatgtgatatcttacagtgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385625 - DNA, 2854 bp, Homo sapiens
cggtacctcgcgccgtgtatcccaccacgcccggccaagataaagtcagtttttccattgattatgcatgtttcttttaatttggatctcctaaatgtaaggtagaaggtttaggttcaaatcttgatatcttttcattatttttcagctcactttgcaaatatccattaaatacctgccatgtaccaagtgtttttcaacacctaaaggaaggtaggacttgatatgagagccctctagaattcttattgtttaggcctctttctttgtctcagggtgtccagggtggtcgagccaaacgctattcatcccagcggcaaagacctgtgccagagccccccgcccctccagtgcatatcagtatcatggagggacattactatgatccacgtgagttttttcttactgttggggtacttttcttggcagggtgaagtgaagtaagataccaggctcctggctcctgaatttctcttctgacctcttatagtggttatcaaacattgtctggttgctgttttcttcgcatggaatattgagaacatcttttaaagggcttggggaacaaggagacttgtccatgtgaagagtaagggtttatgagagtcccaatgtgatatcttacagtgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385626 - DNA, 2491 bp, Homo sapiens
gagacagagtctcactgttgcccaggctggagtgcagtggtgtgatctcggctcactgcaagctctgctcctgacctcaaccgatccacctgcctcggcctccgaaagtgctgggattacaggcataagccaccgcacccagcgttcagtttctttaatggtgtttctttcctgtgttgtggtacatcataggtggcaatacctggtttttactctattgcataaagaagctgtattctactccttatcacccctacctctgtcctgcttaacttccaccacgttgacataatcaagtatctgtagtgtcgctactgaactcagccttttccatttgtcagctgatggtaggaattagagaaagctgggcagtactttgaagaaataaaaaccagagcataataatgaagaattaaggcaaaaatgaatagtcactttattttgaagggtgggcagattagatatttttaaaattataaattccccaattctcttatggctgaataatatttcctgttcatcataggttggatgaattcattcctaactttttcttctcctggcttgtggggtcccaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385627 - DNA, 2127 bp, Homo sapiens
cccacccagcctctgattaatgctttaagttataataatcatgggatatctcaggaggcttaaaggagtcctgaaatttgccagtttgtttgtttggcaagtgtattgggcagggttgaagtagaaacgattgttaacatgacagttttcaattgggaagctacaaggaaaaaatacaggaaggcagtcaaggaaaagggaaatctaaatttgagatgttatagcagaaaaaaccagttctaaagatcatagaggagaaggactgggggttttgttgcttttgtttaaggacattacttaaaacacattatttagaagtgtggctttttgaaaacagcttgtgaatgcccagaaggcccactaacactttggtggttcttccctttttccaacccctgtcagagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385628 - DNA, 1914 bp, Homo sapiens
ggaatcgagctcggccctactttccacaggtgatcatagaggagaaggactgggggttttgttgcttttgtttaaggacattacttaaaacacattatttagaagtgtggctttttgaaaacagcttgtgaatgcccagaaggcccactaacactttggtggttcttccctttttccaacccctgtcagagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385629 - DNA, 1632 bp, Homo sapiens
taagtactcatggttaatcatgtgttgacacttacccataacctcaccagtgtggttccaaggtcttactgatactccagaagataatactctcaaccccaaatgataaggaatttcttcgaacacatcactcctcagttcacaaattcctcctgggcttctagatgtagctccagtgttagcatctggcaagaagctgtccttgaatactctaccctcatctatgcacctctcctttgactcctacaccactcacctgtcctgctcaccccagccatctcttctctgaacaccacagtaacaatacttgtcctgatttatatgtggtggagcatgtgaagaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385630 - DNA, 1050 bp, Homo sapiens
cagaaacatgaactagatcggccgtggttaattcgttaacgagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385631 - DNA, 986 bp, Homo sapiens
cggacgcgtgggtcgacccacgcgtccggagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385632 - DNA, 615 bp, Homo sapiens
aaattgagcagtgcgggcgggtgggatcggcagaggggcgaggagcagcacttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385633 - DNA, 3451 bp, Homo sapiens
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttcagatatgtgtttgtgtttttttgtggtaaagtaaggagttacggctggcatgtgataataggtcagggaaaccagattgtcgggactatgacctttttctccagtatgctacctgatcttctttggcatgctcctctagtcggcagcaaacgtttat

SEQ ID NO: 385634 - DNA, 2774 bp, Homo sapiens
  misc_feature (2773)..(2774): n is a, c, g, or t
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggtagtaagcaggggttcagttaatacaagtcctgaatatatgaaaatcttaacatcatctaaacagaggtgacaaatcagaagagacatacaaggtggatatctactaacaagaagggctgcaaagatatacaggagaggcacctaacaaccaagcagcgacacacggggaccccggactcctacggaagacaagaccacaacgaaggaaaaaccaaaggacacggaccaagcacagacgacgtgaaagcgagacgacggaggaaaagaaaacgcacacaggccaggagacgagcgcacaaaccgagccccaacgaacgcagaagacaaatcgggacaaaggaggcttcagtcccaagagacgccccgagagacacgacccaacagacgcaagaaaagacgagactacacacgacgacaaagaagacacgcgaccgccggaggagatgcagacgaatcaatgagann

SEQ ID NO: 385635 - DNA, 281 bp, Homo sapiens
atcaagccccctccacctgaggtatgagagttccttcctatacttaatgcacatgctccgtcagtgggctttccttctccccagaggatttccctcattttctgggtgtgtttctctggaaaacagtctttttgttatgacctgataacaaattccaactttgttatttcaggttgtaagcaggggttccagttaatacaagtttctgaatattttaaatcttaacatcatataaaagtaagtgcacaacttactgtgaatattgttaaaactaatgctca

SEQ ID NO: 385636 - DNA, 482 bp, Homo sapiens
gtgcagtgacgggatcacggctcactgcaagctctgcctcctgggtcccagttcaagcaattctgcctcagcctcccgagtagctggcattacaggcacgtgccatcatgcccagctaatttttgtatttttagtaaagacagggtttcaccatgttggccaggctggtcctgactcctgacctcatgatccacccaccctggcctcccaaagtattgggattacaggcatgagccaccacgcccggccaagataaagtcagtttttccattgattatgcatgtttcttttaatttggatctcctaaatgtaaggtagaaggtttaggttcaaatcttgatatcttttcattatttttcagctcactttgcaaatatccattaaatacctgccatgtaccaagtgtttttcaacacctaaaggaaggtaggacttgatatgagagccctctagaattcttattgtttaggcctctttctttg

SEQ ID NO: 385637 - DNA, 4224 bp, Homo sapiens
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgctcactttgcaaatatccattaaatacctgccatgtaccaagtgtttttcaacacctaaaggaaggtaggacttgatatgagagccctctagaattcttattgtttaggcctctttctttgtctcagggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385638 - DNA, 3861 bp, Homo sapiens
ctggagatggaaagcggatgttttattcagaagtcggggctggagggaaggagaccagacctgccttggctactacttgataaagatttacctatctctgtctccctctccaaccattttgtgctgaatcttcagcttttcacccacatttctttattgggctccccacctctggaaatcacagaactaacccatgtcttctgctttctttcaggagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385639 - DNA, 2092 bp, Homo sapiens
  misc_feature (21)..(21): n is a, c, g, or t
caactaggctagtacgaggcnggttgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385640 - DNA, 4095 bp, Homo sapiens
acacacacacacacacacacacacaccccaacacacacacacacacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttgaatagctgtgtagttgggatcctcaag

SEQ ID NO: 385641 - DNA, 622 bp, Homo sapiens
  misc_feature (94)..(94): n is a, c, g, or t
  misc_feature (96)..(96): n is a, c, g, or t
gaatctcttccacagaggcagcagagaagtggtttagtgccatggatagggaggaaagataggagcccttgcccagaaggtgactggcttcctnangccttaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttg

SEQ ID NO: 385642 - DNA, 782 bp, Homo sapiens
tggatcacttgaggccagaagttccagaccagcctggccaacacgatgaaaccccgtctctactacaaatacaaaaattagccggaggtggtggtgcatgcctataatcccagttactcaggaggctgaggcacaatagtcacttgaaccaggaaagcagacgttgcagtgagctgagattacaccactgcactccagcctgaccgacagagtgggactctgtctcaaaaaaaaaaaaaaagcttgtgtgaagagcatctactgagctgggccctggtgctgttttagagacagaaaagcagtaagagccattcagagtgtggtggagagacacatattacaaaaggcgattctatttctggacgtgatcaacagcaggagacagcaaggtctgacctataatagagattttcacatgtgttttatcagttactgcttctaatactcatccctgtttttccacatgaggaaacagagttctggggttccatggctggtgagaggaggcgctagagtctgagcccacatgctccccgctcccaagccaggcctctgactgtaacatcagcaagcgtgccaaacaaaccttagatttttttttttaattaatatacatttaatggacttctttgggccctagttttctcatctgtaaataggggtaacagcatggactccctcagggccatttgagtgtgcaaggaggctgaaccacgcctcgcctcaagggcagtgccaccacctcccccattagccttggtaaatgggagcaatttttaaca

SEQ ID NO: 385643 - DNA, 365 bp, Homo sapiens
tagctgattctagaggatccacccgcggcgagttcatgcaggtgtgtatgtgtgtgcatgtgtatgtatatgtgtatgtgtgcaaatgtgtgtatgactatatgcatgggtagctgtgtgtccttgtatttgtgtgtgtgttgggttttcttgtgaacaatatggcctgttgaggcttctactattctcctggtctgaaatgcttggtaaacctcgtgtggttaaaccagggtttacactgtacttgaactgactacaccatgtccatttgagggcacttggagaaaaaccagggcccattttgagagaaagcactttataaatgcaggaaagaattccttagcctcaggcaagttctgagatga

SEQ ID NO: 385644 - DNA, 491 bp, Homo sapiens
ttcctggggccagtcagagatctaagttaaaattagagtcatacacttggtctttgaagatgcagtcatagtcgttgggctaacagaaggcatttcctgacaccatttatccattacctcactctagaaaacggcaagttgaaatgagatgggagaaatattagatacctcaaaaaagataaaagagacaggagacaggtccagtgtttgtcacttctggaaacagcagctgaggggtccggacggccctataagagcaaatctcgttcagttccttaaagtaaaatcaagacagcctcacacacacacaaaaaagggcatttttcttatgaccattactgccagagattgctttaaaccaaaaaaaacccatttcaacatttcgtaaatctaacatctaagaataaggctattcagcctatggtttaccacgttttagttcattttataagttgaaaatcagtgtgatgtgatagaaaggagagtggaaa

SEQ ID NO: 385645 - DNA, 491 bp, Homo sapiens
tctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcgccctttctacagatgaggaaacagacaacagattggtaaatttcccaagatcacaaagtaagtcagtaggaactcaaagtaacctgactccagagcccacactctt

SEQ ID NO: 385646 - DNA, 456 bp, Homo sapiens
tttgctgctatatcccagtacctgaaacagtgcttggcataggttagcgctcaatgctgttgtgtgaatgaaaggacaaatgaatgaatggcagtgagagaatggagctgcttcttctctcttagagggccaaaagggaacccatggatgtggaaagcagcagccatgggcacggcaattgtagctcgctatcaggaagaacgctgcaatgactggaagactgctctggaacatagctggtgctctgccacaggtcctgagcccccaggacagtcccacagtgggcagaggctgggctgagacaaaccaaaagtccttccaatcctggagaatttgtgtggtggtgtgtgtggatatggaagtgtgtaagaaagagaaggaaggtggacacagaagaggagagtgggcagatacacgctccccaggctggctccttcaaaccagacaaaagaaagg

SEQ ID NO: 385647 - DNA, 1159 bp, Homo sapiens
  misc_feature (422)..(422): n is a, c, g, or t
  misc_feature (425)..(425): n is a, c, g, or t
  misc_feature (509)..(509): n is a, c, g, or t
tgcatctgccaaacaatattatcaggtatttagctacatcagactctcataggcaaataaacttgagaaaagctactgaatattttctccttttggagactcttaaagaacattagcatattgtaggcactgaacagagaaatttgtttgtcttcattcggcccattgtttttccatatgtgattcaacctgtagcatttttatttgtaaaactcctattatgcttaggaatgaatccaaggaatacagttatagaaatgctggaatcaagtataaacctttcttgttgtggaaggtggacttcaagtcttggcttgtagtggagaagaatgaagtgagaatcagaaaagagaaggtggtaatcaagggcttctctctgtcactcactcttcctaggtatggacaaactgcctttgtcatcnatnccattatggcccagagagcatctgggtagtcattacagaggatcttcttaagacataaaagtgtcttttgtaaactctgtggtntaaaattgaaaaaaaagtgaatttcaaaaaattattattaatggcacttttaccacagtgctttttatcataaaacctagatatctacattgaaggtggataaaaaagggagtgaatgtgaacaaatggaaaggacctttggatctgagatgtaagactgtttgaatccttgcttaggcatttctatatctgaatctcattcttttttttcactttctatgtgtgtagaactggtaaacaaatgaaaaaaatggatagaatatgtggtaaataagtgccatgtattattactacacattttagttctaaatatctaaacactactttctcttggataaaatatcatgcaactagagattcaagaaaatgctacaaaattacatataaaaataactccaaattagtaaagaactagaacaagaaatgattcacacacacaatttttaaataaagtgaattgtttaaaaaattccgaaacactaatgtggtataaatatcattggctatgaaatggtataactgcatggggcttgctaatagaatacaaaagttattatactggaaatattgcatggaaattatatgtttttatatgtaatcatcatgtaatcctttatgtgaaaagaagcttaagacacctaatccatttc

SEQ ID NO: 385648 - DNA, 221 bp, Homo sapiens
tcttcagctctatatgtgccagattcatataaagactgaggtgtgaggaggccacagagggggccatggtcatgtgctgtacagcctggactgagggaagccacagtgcacagcctgtgctcagcacatcccgatgtggctcatgtccatttgggttctgtgtcttttctgtgtcatccatgtcctgtctcttctgtgggctcagaggcatgattgtgtcc

SEQ ID NO: 385649 - DNA, 2250 bp, Homo sapiens
  misc_feature (1764)..(1764): n is a, c, g, or t
actgtaatacaataatagtagaagactttaataccccactttcagcaatggacaaatcatacagaaaaaaagtaaataaaacatcagacttaacaaatttagtgatattaaaatcatatcaagtatattttccaaccacaatggcataaaactggaaatcaataacaggaggaatttcagaaaattcacaaatacatggaaatgaaacaacatgctcctgaacaatcaatgggtcaaagaagatattaaaagggaaattaaaaattaccttaagataaataaaaatggggacacaacataccaaaacctatgtgatgcagcaaaatcaggtctaagagggaagtttatgggattaaacactaacattgaaaagaaaaatgacctaaataaataacctaagagtacacctcaaggaactagaacaaactaagaacaaactaagcctaaagaacaaactaagcctaaagttagaaaaagaaaataataaagatcagagtagaaatgaatgaaatagagactagaaaaacaataggtcaatgagactaagaagttggctttttgaaaagataaacaaaattcacaaacctttatcaagactaagaaaaaagagatgattcaaataaaataaagaggaaacatcagaactgatactacagaaatgcaaaagaccaccagaggctactgtaaacaagtatatgccaacaaattgaataacctagaagaaacagataaattcctagacacacataattctaccaatacggaatcatgaagaaaaataaaatctaatcagaccaataacacgtagatgcattaataagaaatgctttcccataaaagaaaagcctaggacctgatggtttcattgctgaattctaccaaaaatttaaagaacaattcctctcaaattcttcaaaaaactgaagaagagtaaatacttccaaattcattttatgaggccagcattaccctgatgctaaagccaaagacactacaggaaaaggaaactataggtcaatatgcctgatgaacacagatgcaaaaatctcaaacaaaaaatgctagcaaactgaattcaacagcacacgaaaaggatcagtcaccctgatcaaatgggatttattcctgggatgcaaggatagaccttgtcaacaaatgcaaatcaatgtgattcatcctattaacagaatggataaaaaacatgtaatcatcccaatagatacatctgataaaatttaacatcctttcatgataaaaactctcaacacattaggtatagaagaaatgtacctcagcataataaaggccatatatgacccacacacagctgacatcatactcaatggtaaaaagttgaaagcttttcctctaagattataaataagagaaggatgcaacacagtactggaagtcctacccagacttggtaggtcttccaagaccttgaaagccaggtggggtggctcatgcctataatcccagcactctgggaggccaaggtgggtggatcacctgaggtcagaagttggagaccagcctggccaacatggcaaaaccccatctctagtaaaaatacaaaaattagttgggcatgatggtgcatgcctgtagttccagctactcaggaagctgaggcaggagacttgcttgaacctgggaggaggttacagtgagccaagatggtgccactgcactcaatcctgggcgacaaagtgagactctgtctcaaaaaaaaaaaaaggaattgaagaagacacaaataantggcccaacaaataaatgaaaacaaatcccttgttaatgaactggaagaatttatgttgttaaaatgtccatattactcaaagcaatctgcagattcaatgcaatccctatcaaaattccaatgacttttttcaaagaaatagaaaagcaattcaaagattcatatgaaactacaaaaaaaccttgactagccaaaaaatcttaaccaaaacaacaaagctagaggtatcacattgcttgacttcacaatatatcataaagctatagtaaccaaaacggcatggtactgtcataaaaacagacacacagaccaatggaacagaatagagatcttggaaataaatccacacatttatggtcaattgattttccacagagggtaagaatacacaatgaggaaaagataatcccttcaataaatggtgttgggacaactgcatatttctgtgcagaagaataaaattagaaccttatctcataccatat

SEQ ID NO: 385650 - DNA, 354 bp, Homo sapiens
tggggtttttttttagtagagatgggatttctctatgttggccaggctggtctcaaactcccgacctcaggtgatccacccaccttggcctcccaaagtgctgggattacaggcgtgagccactacgccgggcctaatattttaatattttaagtgttaaaagtacacttcttctagtttcttcactcattcatttattcagtcatttcaaaggtattgaatgagcatctgccaggtgctggaatgttgtataacactgctttatttattttacttatttatttatttatttattttgagacagagtctttctctgtcacccaagctggagtgcagtggcatgatctctgctca

SEQ ID NO: 385651 - DNA, 423 bp, Homo sapiens
tcaacaatttcagatttatttgccataaaatttactttgaatgcaattacaattttgtccaaaaacttcaaaatataaatctgggtttttttttaaaggaaattcttcagaaagatactggtgacactctattcatgccagactcagctaagaagctaatttaggccgggcatggtggctcatgcctgtaatcccagcactttgggaggccaagacgggtagatcacaggagatcaggagttcaagagcagcctgaccaacatagtgaaaccccgtctctactcaaaatacaaaattagctgggcatggtggtgcatgtctgtagtctcagctgcttgaaaggctgaggaaggagaatcgcttgaatctgggaggtggaggttgcatgagccgagatggtgccactgcactccagcctgggtg

SEQ ID NO: 385652 - DNA, 1217 bp, Homo sapiens
ctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaagccgttttgcacacctggtcagaatgaaacattccttgggaactcggcgt

SEQ ID NO: 385653 - DNA, 1595 bp, Homo sapiens
ctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatgttttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcaggcttcttgtctccaggatgaaaataaggaggagttgtcagacaaggacatatacatggaggctggcatcttcatgagtgccaatcgtggtcctggtgtggactactgtgggagc

SEQ ID NO: 385654 - DNA, 839 bp, Homo sapiens
agacagggctgggctgatggccaaggccactgcaggtgaagggggaacccttatctcccaggcttttgacctccagattttagcaggggagcttcgttgtcggatttgggttcctgagaatctactctggccaagacggagagggggtgttgaccagatgggaaaggatggagacttgtattgccccagtaatgagcgggcagggtagattagaacaagatgtcaggacttgggggctgaatgccaggcttctggctgggattaccaccccctgacacatataatgcccaggaaattggaggcccctctccaagcccccaggaggccactggggactcattccaggatactcacctgcctgctttgtggttttggaggggaagaccttggagcagttgcgaagatccatctaccatgttctggtttttccttggaagcctaaaagtgtacctcgggatgaggaggaaatggttttgagggcaagtggtaggtctctggctaggcctggcggggttctcagaggacagggggtgtctagggccctagatagaagtgtcctgcccaagccctaaagcaggaaattagctggggagttggggtgagaccctggggtcgatggaggcactttccatgggagagtcccacagggtaagggagagggggctgatgtctgacagtctcatagacagttggcttgtggctggagaagtgggagcaaaggagaaatcacctttgattgggagaagtggctctggctcatgtgcaactgagacaaagccagtcctaagagcagcttgtaaattcttctgtgaccacctttaaggtccttcttcctgagg

SEQ ID NO: 385655 - DNA, 480 bp, Homo sapiens
aaattcatcatcccttcatgataaaaactctcaagaaactaggcatcaaaagaacgtaactcaaaataataaaaaccatatatgataaactcagggctaacatcataatgaatggggaaaagctgaaaccatttcatctaagaactggaacaagacaagggtcttgttttttcaccttcatcactactattcaacatagtactggaagacctagccagagcaatcagacaagagaaataacagatatccaagttggatatctttacatttgttcctctttgcaaatgatataattttatatctagaaaaacctaatgactccatcaaaaccctcccaaatttgataaatacaatatagttttaggatagaacatcaatatacaaaaatcagtagtgtttgtatgcaccaatgacgaaatagctgatgatgaaatagtggagaaagaaattaaaaaggcatgcctacttgaaatagctacc

SEQ ID NO: 385656 - DNA, 461 bp, Homo sapiens
taaacttcataaaacattactgcctgattgttgagtgggatgggaagggagcgtttaattcagcacctgcaagctgcaactgccagcagatttctgcattcagaggcattttggtgtttgtgtatgcataggacagaaggaagaaataagcaggcctttatcagtatgttcttttctaaagatcattactagatttgaccaaagttctcataactatatttaacagtctatcagtgctttcttgagtgtttccttaatgctagtaaattctaactctcacaaattcccatgggctacagcagtgccatctggaatttagttccttttactaatctgtgatttaaacatcagaaagatattgccataattcccaaataaacacttaacatgtgtgggaaggttcaggataatgggccttctgatgacctaataaaaaatgaaggtggtaaaatcataagcca

SEQ ID NO: 385657 - DNA, 394 bp, Homo sapiens
tttctctaacaacctagaggcaaacagtttggggttttctgtctagagctttaatggccaaataaaactgtgtgcctatttaatagctctaattacttttataaagttgacccaaagaccacaggtctgataggattcttactattcttttccacgtaagcctaaaagcaaatcagagttacattacagaataataattaatacttaatagtgaaaataataatgacaactaagtaactgtatttgtaaaatcttattctaaaaatggtgattcatgcatagtaatttgaatatatggtcacatattttatattaaaaaacataaataacacagcaaggcaatgtagtcttctttctctgttatgtgtatctttaaaaggccaggttgcctagg

SEQ ID NO: 385658 - DNA, 199 bp, Homo sapiens
tgcttatgtaaatatatttcctcctgaattatgtctggtactaactcctgctaagttagtggcagacatgatagcacttcacccctaaatacctaagcttgaatcttctcaaaattagagcatttggggtcatttttaatttaccttctttggccctcattctaacttgtcatcagttctttgagaggcctcttgcatc

SEQ ID NO: 385659 - DNA, 499 bp, Homo sapiens
  misc_feature (495)..(496): n is a, c, g, or t
  misc_feature (499)..(499): n is a, c, g, or t
gcctcccaaagtgctgggattacaggcgtgagccaccacaccctgcccaggaatacatgagactttgaagttctgattgctaacccaagcaatgttggctgtaattatcaggccccgctgtgttcagaaacttaaagtttaggtgggaaagtaaaactcagtaatcataggtaaacagagaccaagtaagcgctgctcttcgaggtctagatatagctgtggcaagaggcacgctggggaggaagaaaagttctgggtaacctggaggggtcagggaggagtttcagaatgtagtcgtggccttggcttgggtgtggaagtaatagcaaactcagcaagataccttttatgttttgataacggctttatggagatataatttgcataccattcaattcacccctgtaaagtgtataaatcggtttttagtacattcatggagttgtgcaatcattaccatcatcaattttagaacatttccagcacctcaaaaannaan

SEQ ID NO: 385660 - DNA, 409 bp, Homo sapiens
gatatttaaggctgagactttggaagctgaggcagacaaagtcagtgaggatggaagcttcatggagctgaaagaacttcatgtgttcaaagagttgaaagaagcttagcgtggctgctctggagaggtgagggggacccacgccaaataatagagggctgtggctaccacgtgaagggttttgtgtttttgtgcatttattgaatacttactgtgtgccaggtacgtgtcaggcattttcacatcaattttttatttattcctcctcccagtcttaatgaggtgatgtttttcatccttgattttgagttgaggtaactaaggctcagagagattaaaccttgcccaagtgagtgtagccactgagtggaagagctgagattctgaaccctggtgttctgacttccac

SEQ ID NO: 385661 - DNA, 377 bp, Homo sapiens
ttcctaaaagcagtctttcctacaacttgtatgcagtaagtcacttaagcacttaagtgtcatatgggtacttacatggaattagagcacttcctgaatggaattagaaaaaggcaaattgtgcatactactgatgcattcatttcctacagagatatgataccaagggccaataagtgaatagaaaaagggaggaggatttattaatggaatgagttctaaccctgtctcttaccagccatatgactttgggttaaataatcaaacgcccaatgagctcaactgtctattattagggaaattaaatgagagaatgcacattaatatgcattgcagagtacatggaaaatagtaaaagcttaatatttaatacgttc

SEQ ID NO: 385662 - DNA, 492 bp, Homo sapiens
ataaacatcagttctataggacaattgggaggcttttttatatctcaaagaactacaaacattatgataagcaatttatacttgattctgccatgtgtctacctttcttattataatataggatcagggttccaatgttgaaatggacaaaagccatcattccaaacaccccactggttctccaagccatgcccaagcacatcactctcatcaatatggggtatctctaaagaggggtaaatcatttctctctctctagcactcagcacccaacatgtatactcaagtttgcaggtgggtacaggaaaggacagttcttcatcacaaaacactagttacccttggcttcactatgacacatttaagtggagaacattagggaatagtcaaaggtgtgttgaaattaattctcaagttttcaagctcagactgctaggtaccctactgactgagtctatacccaatgataccagtgaaaatgctgggggaaaa

SEQ ID NO: 385663 - DNA, 591 bp, Homo sapiens
ctgaagagcgggaaggacccatccactgggagctgctggagaggttgcctggcttcagtgggcatggaggggcctcaggtgttctataaagtggtgctcacatctcagctttgcagggttgttcaggagctaagtcaggggccaaggcagtgagctggtgggctgctgagtcctcagtgggtaaaggagtccactcacttccagggacctgagcagaccccacattccccaaggcccccagctccaccctccagaggctgaggagagccaggaaaggcccatggatggggaagaaggaggcttcttcctgggggtcctgaggggcccatacaagtgggtgaggcccgagtgggcacagcttgggggagagatttccaggtggctgtggtgatagtgagctcagtctgtcccagacgtctgtcaacaggtaggtctaaggagcgagtactcatgggaactgggtctcctccaagtccccctgtgttcctagcacctggccccaccgagagctgagctgctgtgagcaggaggaatacttcaaggagaggcaggcagggagcatggagtcccgacagaaggtgtgcgtgtggg

SEQ ID NO: 385664 - DNA, 434 bp, Homo sapiens
cagtcataaaaagaaagaaaacatgtcatttgtggcaacatggatggaattggagagaattatcttaagtgaaataatccaaacacaaagaaataaatattgcgtgttctcacttgtatgtgggaactaaaatatttgatcacatggaggtcaagaggggaaaaataaataacagagactgggaagggtgagtgtgggagaaaagagaggaagaggaggactgggttaaagggtacaaacatatggtaagacagaaggaattaattccatatttgatggtggagtagggggactgtacttaacaaaaatcgattttacttgggtgatggctgtcctcaatacgttgacttgaccgctatgcgttatatacatgtaccaaaatttcttatgtaccccataagtttatagaaataaaaaacagcaaaaaattgtat

SEQ ID NO: 385665 - DNA, 434 bp, Homo sapiens
aaggtaggctgctgctgtgcacatgagtttatacacaggaaattggaataacttggaatttctatgctggagactttggctacttctggatttcaagcattgtatgaagtgtgagaaaactgaggtgactagcacattaaaccatccagattctagcctccaggcacactaaatttaagtcttgataaaaccaggaggccatattatgatcataagtaagatgaagtttagccttccttttagtccattttgtattgccgtaaaggaatatctgaggctgggtaatttataaaaggtttgccgggtgcggtggctcacgcctgtaatcccagcactttgggaggctgaggcaggtggatcacgaggtcaggagattgagaccatcctggctaacacggtgaaaccccgtctctattaaaaatacaaaaaattag

SEQ ID NO: 385666 - DNA, 382 bp, Homo sapiens
ttcttcttggtgaagcctccctgacatcgcctctggcactgataccaccctctgagccccagcacagtcccagcaaaagccgcgcactgtgcaacagaggcctgcgctcgacctcgcggtgcactcagcaggggctgccctcggtcccaccgtctcccttaacgcccctgcctcccagtcccacggcccccaggaggagccagtaccctagcccagggagccgggttgggcgcggcctggggaccgggcgtgggaagctggcccacagggtcgcccctagcaaggaaccaccagagcgcgcatgcgggagccgaggccgcagcactgggtgggcagctagctcaccgaagacccacgcagcgggccaggcgccagcggccgc

SEQ ID NO: 385667 - DNA, 230 bp, Homo sapiens
ggggttctctgtggtcattgcttcttcagaatcactgatggccaggttcactcctcaagactggaaggagcgcccacaaggatgggattttcaaggccagaactccaggtatttttaattttttttttaaattttaaaattgtacaggggccaagcacagtggctcacacctgtaattccagtactttgggagaacatggcaaaaccctgtctctactaaaaatacaaaa

SEQ ID NO: 385668 - DNA, 621 bp, Homo sapiens
gggtgccttcctccaggccgtgtgtggaaatgcattgagccttctcagtgtgtcctgatgttgtaagtttccactttaatgcagctgcagagactgcgtcccacccgaccgcctcccaagatacagcgctcgaggcccgtgagtagctggtggttctgccctccccacctaacactgcctgagccattctccctcagcctgactaaacctccagagtttggaccctcctgcctggcaaaagaaaactgggaattgggtttttcagcttccctctctgtgtggcatgaacttgagcttgcattctctgggcttctcttgctttttcgtgaataagtttggtgacttgcagatcagagccataggtagcaagggggccactgtgtgctgcgtgtgctgcgtgtgcattatttgagcaagtctcctagggtgagcaatgggttggaagccttcctccagacgcctgttcctcacaaacgaagcagaagtccgggggcaagggtctcgttcccgccagatcttggtctggagatgcatttgtaccttcccaggggtggaggctatgtccagggagtatggagccagctcatatggatacaggtaccgctgccctgccaggccttc

SEQ ID NO: 385669 - DNA, 359 bp, Homo sapiens
cccgtgttatggtatctgctcgatgaacggccacttgtagggccactaggcctatgcattgttgagtgggagggcccgtgtcccatctcccccatggctccaggcctctctgaggagagctgaaggaggtggactgactagtccccgcacctccccgccactggctttccgggagacaggaggcagggtcctcagtgccatactactgaggctcagcggccaagctctggctggagccacggtgaggaaaggattagaaacccagatcccttgagccctgccaagtcctcactccctgggaggtgctgacaggaggcttgaggccaggcaggagcagcccatctggcccatcttctgcc

SEQ ID NO: 385670 - DNA, 480 bp, Homo sapiens
ctcctgcaggtacatggtgcgggtccgagctgtggtgatggcccgagatgactccagtgggggctggctgcctgtggggggcgggggcctcagccagacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacggtgagtgtccaggatgcctctctgctgggggagggtaggggttttgtttttattctatgaacattcttgagcacctactgtgtagcaggcaccatgccacacaccgggtacacaaaattgggccggaactatgagtg

SEQ ID NO: 385671 - DNA, 685 bp, Homo sapiens
ctcctgcaggtacatggtgcgggtccgagctgtggtgatggcccgagatgactccagtgggggctggctgcctgtggggggcgggggcctcagccagacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgctctcccagtacttcaggcatatgctgtgcccttgacagtggccctaaccgcatccttatgaataggtactcttaggatccccgttttacagaggaggaaactgaggctcaaagagtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcg

SEQ ID NO: 385672 - DNA, 414 bp, Homo sapiens
gtctggatctattcattttgtagttgcgagaaaaggaatgaaccgtgactatggcaattcaccgtgacgtgtgataatttagtttgctatgagttttcactcttaggtaaaacctagttatcctaattaataattagttatggatgatatagtaattttttttttttgactgcgtctcactgtcattcgggctggagtacaatggctgatcacagttcggtgcagcctcaacctccctgggctcagtgattctcctacctcagcttcccaagtagctgggattataggcatgcaccatcatgtctggctaatttttgtatttttttataaagacagggttttgccatgttcaagacccaggctggtcttgaactcttgggctcaagcaatcctcccacctcggcctcccaaagt

SEQ ID NO: 385673 - DNA, 544 bp, Homo sapiens
atgggactcaaggtaccattcatccgtaggcaaattcctctacagctgtgagactgaaatcaaacaagtgatgtgcttccaagatacaatggtgggagaagtataggataggtactgccattccaaaagagagaaataggcaagaagaaaagggtaacaagtttcaagtaaatccaaaacccaacaggaaaacaacattaaaccttagagcttgagctgggtgcagtggtgtgtgcctgcagtctcagctacttggagaggttaaggtgggaggaatgcttgaatctaggaatccaaggccaccctgggcaacacagtgagaccctgtctctaaaaaaaaaaaaaaaatcacttaaagttttgagaataatcttctttgactccatgtcctgccttctagacacttaggtgggagttggtcctttaacgtttccagggatcccttccctaatggctttgctgggtggtccacacagcagctctcatgggttggagtttggtgactgcccctctcccaggctgggatcatactccaatggctcca

SEQ ID NO: 385674 - DNA, 646 bp, Homo sapiens
tctcgctctgtcgcccaggctggagtgcagtggcgggatctcggctcactgcaagctccgcctcccgggttcacgccattctcctgcctcagcctcccaagtagctgggactacaggcgcccgccatcacgcccggctaatttttttgtgttttttaggagacggggtttcactgtgttagccaggatggtctcgatctcctgacctcgtgatccgcccgcctcggcctcccaaagtgctgggattacaggcgtgagccaccgcgcccggccgtaaaatcatctttgaacacagcattgtatccatagcaaagtcatttgtggatgccctctcagagaagccaaagggctgccaaatatgaataggagcttccaagtctcctactattgttttctttcattaaattgtattatcctaacagataacttcccaataaaggtaaaaaatttaaatactaaaaaaactgctcttaaaaacattgctaacacttgcagaattcaattttgattaaaagtccaagatgagtatttcatatgggtttgtgcagtggcatgcaaaccacctttcacattcatcactctgtggattgagtccagggtgatatatttatagatctactacgtgtccatccatcttagagccatag

SEQ ID NO: 385675 - DNA, 128 bp, Homo sapiens
cacacctttcattcctgatctctggatcctaaacactgacactcattgtaaacattggttttttaatatatctggggcacagctcagtaaattgagcagaggaagaaagtggtatgttgtttaagttt

SEQ ID NO: 385676 - DNA, 505 bp, Homo sapiens
aaatgattagtagaagaaattactcacatattgtctgctaaaataaatattaaaatttgactacatgaaaaaatatagtttcttgagctgatcaaataaattgatcataattcttcctcgttttgttttctgtgtctgtggaagtcatagcgaatccagaaaatgtatagcttgaattctgttgggtttttttttttctttattacttagtttacatacatttttgtcttcctttgaacttactttctccagacttgggtatgtcatgggcataaatcaaaccactcagatccacttctggaggttgatgttggttttaaagcaggtccttgtgggcatccgttccctttccattgctagtcagtacagagcttaccttttatcaaccagataaaaggttctgatgcaaataatttgacaacccattagctagaaaactatttcctgataacttaaaatcgaccgaagccttcccccatatgtaacactgttctgccattccctt

SEQ ID NO: 385677 - DNA, 514 bp, Homo sapiens
ctacattcaaatctttctaaaaagacatcagtctcatttggttttacaagtgaattctataaactttaacagactttttataggtaagaaagtgaatactacacaactaatttatcatgctagtataacactgatatataaaacagcaaaggaattctaagaaataaaaattataggacatgtttcctatgaacatggacacagaaattataaataagtattaataaactgaatactgcaatgtacaataagagccaaaggccagtatcaggttaatacttttgaatatatattactatataatatccacattaacaaattaatggaggcacatctcaatagatgcagaaaaacttctgataaaattcaacaaccatgagtgatttttttttttaattccacagcaaaggtcctgttcaatgattgaggttgtttaaaaaatccttaagagcaagagacatagggattaggaagaaagaaacaatactgtttgtttgtagatttataatcagtt

SEQ ID NO: 385678 - DNA, 497 bp, Homo sapiens
  misc_feature (497)..(497): n is a, c, g, or t
aatcagtgatgatactttggtgtatgttcaggactgaaaccttcttattgtgctaacttgatggtttctttaaaaataatagtcttgccataaattatgaataagacttgtttttttagccatatactcagaagaacactagagttctccaactggctacgcttagttcttgctttgccaggtagtcccacgcttactataatgttcaatttagagttctaagtataaaatatttttacttatttatttatttttgtgacagagtcttgcactgttgtccaggctggagtgcagtggtgtgatctcggctcactgcagcctccacttcctgggttcaagtgatcctcacgcctcaacctcctgagtagctgggattacaggtgtgagccatggtgcctggctaatttttttttctttttttccttttctgagacggagtctcccactgtcactccagtttgggcaacagagtgagaccctgtttaaaaaaaaaaaan

SEQ ID NO: 385679 - DNA, 210 bp, Homo sapiens
aggagtgaacaagctccctcaggccttttagaagggccccaatccacaagggctctcccatcatgacctcatcacctcccaaggccccaccttcttgtactgtggcactgcaaattaggtgtcagtgtaggagtttcaggagggatagaaacattcagaccatcccagcggtcaagtgttcatcctcttgagttcctccttattctgctt

SEQ ID NO: 385680 - DNA, 361 bp, Homo sapiens
atactaattaagagtatatttgagcaaagaacaatcaaacatttattgatcagtttatgtatatcttttttaaccctatgtaaccactgcctacatgttataactaaagaatagaagaaaagtgtttttataaaataatgatagctaccatttgttgcatgtttattatgtgctatacctcgggctaaatgcttgatgcacattatcttatttatcttcctaggaactctgtaagtgagagcatcagtaattctctccattttacgtatggggaaatggaggtcctgagatctaagcaacttgaccagagtcacacaatttataacagtagaactgagattctaaacaatttttaaattcc

SEQ ID NO: 385681 - DNA, 488 bp, Homo sapiens
tctgaccctgagagaactctagaacagcttcccaggcaggaaggtaacacttcagtaagccagccggtgctgttgctatccacgctagccacattctctcctgcagtaagtcatatatctggggatctggcttcttggtaatatagccatcaggcatcttttctccacaactgcagacttcactgaagataataaagaacagctacatttatagcatgggcaaaacgaattcagatttccttcaaagtagcaaattccctgcataattattaatactacccatggccttctacgagaaaaatacatgatgactctggattaccaagagattaaatagataactctccatctggaaggagattcatatcaggaacaatggaagaataatggatgaagtatttaagtatattcagaaattggatcattttctgtgccaactcattattagtgtaggtaaagtttttaaagcactgttctcaaaggggaac

SEQ ID NO: 385682 - DNA, 152 bp, Homo sapiens
ttgagattcagagcaagttcagagttggatggactaagaatggaaaagccctccattccaatagaagagccaggtagcaatttctggttatggaaccagaagctctcaggcttcaaataaaacagcatcacttctactcttataaaactgta

SEQ ID NO: 385683 - DNA, 1924 bp, Homo sapiens
gggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgttt

SEQ ID NO: 385684 - DNA, 1871 bp, Homo sapiens
gggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgatgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgttt

SEQ ID NO: 385685 - DNA, 1914 bp, Homo sapiens
  misc_feature (1546)..(1546): n is a, c, g, or t
  misc_feature (1586)..(1586): n is a, c, g, or t
  misc_feature (1619)..(1619): n is a, c, g, or t
  misc_feature (1627)..(1627): n is a, c, g, or t
  misc_feature (1658)..(1658): n is a, c, g, or t
  misc_feature (1723)..(1723): n is a, c, g, or t
  misc_feature (1729)..(1729): n is a, c, g, or t
  misc_feature (1764)..(1764): n is a, c, g, or t
  misc_feature (1767)..(1767): n is a, c, g, or t
  misc_feature (1803)..(1803): n is a, c, g, or t
  misc_feature (1807)..(1807): n is a, c, g, or t
  misc_feature (1815)..(1815): n is a, c, g, or t
  misc_feature (1820)..(1820): n is a, c, g, or t
  misc_feature (1833)..(1833): n is a, c, g, or t
  misc_feature (1835)..(1835): n is a, c, g, or t
  misc_feature (1842)..(1842): n is a, c, g, or t
  misc_feature (1888)..(1888): n is a, c, g, or t
gggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcattggcccccntgtatcatgaggcaggaatgcatgaagatgccctccttgntcccttcttgcaaagggaaggcatgcctatccntatgtgcnggcttcatgtgaagtccatgcccccagggancctgcttcctttttcttcttcatggtgcatgccaagggctttccctgcattcttgaatgttcgcngcgganccccgtgatgaatccatggtggtgcgtgggccaancancatgcggggccctttcacacacatgcggtgccctgnggcntcagtccntcaancaatcatgtttancngcgcaancatgcccggtgcaagggtgcccgtgcattcttggcttcttgcttgnaccccgtggtaacgcaagcccagcca

SEQ ID NO: 385686 - DNA, 2250 bp, Homo sapiens
gggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgtttaaaaaaacaaacaaaacccggagggccactagtacagcgtcacgaaaaccagggtcaggacaggggcccccggccattcgagggtcacatggccccaattcgtgttacaaagtgctcacactgagagaccccataaagagccgaaatacaatgacaaagcggttaccggatacacacgcggcagagggacatgcacaacacctacaccgccacgtgactacaacgaacacaaaaggagcgacagcacaacagcaagagcataaagcaacacaagataatcgatacaacacgtcaccgacgccacacgatgagacacaaggcacaga

SEQ ID NO: 385687 - DNA, 1905 bp, Homo sapiens
gggggagccttgacgctgctgcccgggacgcggcccggggctggtgggaacaggggcgtcctcctgcgcgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccctgcgaggtccccccttcccccgcggtgcttcccaagctgggctaaggcgggcttctcttcctccctcctctgtcgcctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaaggtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgttt

SEQ ID NO: 385688 - DNA, 1349 bp, Homo sapiens
cttagttccgcatggccctgaaacacacacatttccccctccttttcctccccctcgttcaccttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaaatggccaagtggctacgggactacctgagctttgggggtcggaggccccctccgcagccgccaccccggactacaccgagagcgacatcctgagggcctaccgcgcgcagaagaacctggacttcgaggacccctatgaggacgcggagagccgcttggagccggaccccgcgggccctggggactccaagaaccccggagatgccaagtatggttctcccaagcaccggctcatcaaggtggaggctgcggatatggccagagccaaggcccttctgggcggccccggggaggagctggaagccgacactgagtatttagacccctttgatgctcagcctcatcctgcacccccggatgatgggtacatggagccctacgatgcccaatgggtcatgagtgaacttcccggcagaggggtgcagctctatgacaccccttatgaggaacaggacccagagacagcagatggacccccttctgggcagaagcctcggcagagccggatgccccaggaagatgaacggccagcagatgagtatgatcagccctgggagtggaagaaagaccacatctccagggcgtttgcagtgcagtttgacagtccagagtgggagaggactccaggctcagccaaggagctccggagacctccgcccagaagcccccagcctgcggagcgtgtggacccagccctgcccctggagaaacagccgtggtttcatggccccctgaacagggcggatgcagagagcctcctgtccctctgcaaggaaggcagctacctagtgcggctcagtgagaccaacccccaggactgctccttgtctctcaggagcagccagggcttcctgcatctgaagttcgcgcggacccgtgagaaccaggtggtgctgggccaacacagcgggcccttccccagcgtgcccgagctcgtcctccactacagttcacgcccactgccggtgcagggtgccgagcatctggctctgctgtaccccgtggtcacgcagaccccctgacagtgaccctcggcccccttttgagtcctcgggcccagaatcgtatcccaaagccctcccatggcctagaaaataaataagttattgttt

SEQ ID NO: 385689 - DNA, 795 bp, Homo sapiens
agcggtccggcggtggcggttgccatggggacggagcttgggtggcaaccagaactagggagctggtggagaaggtggcggccgctggaaggaggcccgggaggtggctgaggggtccaggcggcgggacgactctggccttttgaagaccggggtgggtgctctctaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaagggggaggaggaggagaaagaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaa

SEQ ID NO: 385690 - DNA, 621 bp, Homo sapiens
aaagatctatttgatgagaaagactgaagaaaaataaggataagggtatttcctccatgttttcatggcacaaaatctttgctaactgtgataaggagaataatgccccccccaccccccacaagactgtccctgtcctattctccatgtcaggaaggatatgctatgtaatataagaatatatgatgttacaatgcaagaaagtattaaggttgcacatgacattaagcttactaaacagcggaacttaaaataagagatcatacttgattatctggggggggccaatttaatcacaaggatcctttaaatgtggaagagtgtggtagaaaatatttaaagatactacattgctaattgtactggaggaaagaaccaagagacaaggaatggggaaagcggacaagagacaagaaatgaagacagcccctagaagctggaaaaggcaagaacatgtattctcctttagagtccccagaaggaaagcggtgctgctgacaccttgattttagcctaatgaaaaccatttaagatttctgacctttataattttaaagtggtagatttatgtttctaaactaccaaataaaaatgttttgtctttagtttttaaaagtttaa

SEQ ID NO: 385691 - DNA, 427 bp, Homo sapiens
cctgtttaacctcaccttgtgctcgcctgcttctctctcgtttcccatcactccctgaggacctgctgcccttggctttgcccaggcgtgcacttcctgcacatgaggaatacctgcctgcttctcatggccattactgggcatccctgtattgccggcgacagtggttaccatgtcaggcggcccctgcctctgcgcattggcacacactgttccgcctgtgtggggtccctgttctcactgctatttttagcactcttgttgagtgggggcccattatctctgccagagctttcctggtcccctctctgagtaaagtgtcctttaggtctcctgtcaaagcggctctaaaatgtttcttatgccaaatatgagggctggtcacttaggtgtctacgtttttccttcaatgctgtttttttctgac

SEQ ID NO: 385692 - DNA, 250 bp, Homo sapiens
atttttcattgttgatgttgacctccattacctggctgtgtttacagatttctccattgtaaagttactcattttttccttttgccatgctgtactctttgggaggaagtcactaagcacagtgcatacttaaggagtagggagttacactgccttcattgggggtggaatatctacataattaatttggaatttttctacacaggcaattcgtctcttctccatttatttgtttgtccaatcttttatt

SEQ ID NO: 385693 - DNA, 340 bp, Homo sapiens
gttgggcttcatgtcaaaatataagacttcgccatcagtgctctggggccaggactcagttcaggatgttcgtggcatatttcaccaggctttctcagtcacatgagcaaagactctttttttcattagcaagaatggaaaatgcccaaatgcatcaccaactgaggaaatcattttgtttcaacagatttcaatctctctggcaccaaaacgtgtttcatgatggagctgagggaattctgtcagcaaaatgcagtgttctaagaccaagagaactccattataacacagctcgttagcacaaggatctgaacattcctcgggtcagagactgctctct

SEQ ID NO: 385694 - DNA, 386 bp, Homo sapiens
ttttctcaattactaatttttcaggaaagtagaatattggaggcacaaaatgcaatctcaaagccatgaattctacccttctgctcttagctttgcccaagattgtctgaatgatcttgggcaaatcactgagggcagatacttgctttagtgcctgcaactatgagatggtcaacaactctcatgctctctccccaccctgggcctgatgaatactcagcaaatattacatgagccatcaaatgattaaattgactttggtgcttctattggtctgactagcatgtatagccttttttccccacaaatgacagttacttcctggctttgatctgaaattgcattaatctaccccaaaaagtgagttaagagtattttattatttt

SEQ ID NO: 385695 - DNA, 460 bp, Homo sapiens
ctataaaaaaggtaaaatatatgttttggaaattatgttgagagaaggtaacccttacacatggttggtaggaatgtaagttagtacagccattatcaaaaaccagtatggaggttcctcaacaaactagaaagagaactaacatatgatatagcagtcgtttaaccaagtatatatccaaactatatgatttcagtgtgtcaaagagatatctgtactcccatgttcattgtggcattattcgcaattcccgagatatggaatcaacctaagggttcatcaacagatgaataaagaaaaaatctggccaggcatggtggttaatgctggtaatcccaacactttgggaggccggggtgggaggatcacttgagcccaggaatttgagagcattgaggtgtgattgtgcccctgtcctgcagcctgggtgtcagagcgagaccctctctctctctcaaaa

SEQ ID NO: 385696 - DNA, 752 bp, Homo sapiens
aggggcgtgtgcggctgtcccgggagggctttagcgcagagccgcgacgggcagcgggggtgtgttgcctgacgcgtgcgcagctgtggggcgacacacgggggcggcttctgcagccgagggaccccgctttgcagcctgcaccccggctcccgcgtgcccgccgctgtctgtcgcccgccggtgcgatgagcccagccctgcttggacgctgttcacgcctctgcgctccataccttgctcctgtcctctgtttgcagttccactctagcagagcagggtgggctcctcccctctgtacggtagaggagcctggtcactggcccatctcagtagtgaaactggaggtttgatgcacaggggattctcagtagcaggcgccagtgcctgatttatcgtgagaagcagtttaatatttcggctataaaaggctagaactagttcctaattagaaggtgtgccaggttgtaaattgtcaggttgcaagtagggatgagcacgccaagtttttgcgtataggtctaaagaagttttgggggtgggggaggatgcggtaccccagacctgtttccttgtctgcccagaccttgccatggtgtagctttccatctcttgtgacagtgtctcaaggagcagtagacattctttggctgcagcagatttcgcattgtcttcctgattggaagagttcagttatgaggcttctggttgccagttactcctttcttttgaagagaaagaactggaatcat

SEQ ID NO: 385697 - DNA, 1531 bp, Homo sapiens
ggtggtgccagcactagcccccatgtcggtctcagagaaccttctccccacctctgagttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcacact

SEQ ID NO: 385698 - DNA, 1553 bp, Homo sapiens
atgaggcaagccccgtgtgattgttgaggaggagttagcccattgccagcctgtgacgtgactgactcgaatgaaccctgttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcacact

SEQ ID NO: 385699 - DNA, 357 bp, Homo sapiens
tactgaatgtattcaaaaaaatcaaggtgtgattcctccctaacttatataaaaccattgtcagccaggcctggtggcccgcttgtaatttccagcactttgggaggctgaggcgggcagatcacctgaggtcgggagtttgagaccagcctgaccaacatgaagaaaccccatctctactgaaaatacaaaattagccgggcgtgggggcacatgcttgtaatcccagctactcgggaggctgaggcaggagaatcgcttgaacctgggaggcagaggttgcagtgagctgaattcgcaccattgcactccagcctgggcaacaagagtgaaactctgtctcaaaaacaaacaaac

SEQ ID NO: 385700 - DNA, 433 bp, Homo sapiens
gatatgtagaatgacacaacaattgatgagtaatttaggagatccaataactaaaaaaaaaaagactggggacaagttcatggaaagagtaatcaactaagccttataacataaaattgacaaatagagaaggcatgcaatccagtagaatagagtgcaaaagaggtagaagactaatcgtttcaagacatgttgagccacaacagcaataacattgtgacaaaaaacgtcggtgtagactgcagaagatcttcaatgacggatcaagctgtatagacttttttttaccctcatatactgaatagtcatttaaggtatacagtgccaacgtaagagagaaaggtggtctatcattttggagtttctttccacctctggagaattgctcaggaaatctggctaacataccaaataaatcaaatggatttaatga

SEQ ID NO: 385701 - DNA, 486 bp, Homo sapiens
aaaaatttctctagtaaaatgaatacactgaattttaattaaaagattttgacactaatttaagctattgaaagctgtagtttccccatccataaaataggaattgtaacagaatctattacctaggttgttgcaagcattcagtgaaaacagcatagcatgggcttgccacaaacgtcatgcttaataaacataagctattttttgaatgatagttttaccctatttttttgaatagatcattttactcttctgagatttatttttcatatgtacagtatacaacataatattgtgttgtaaaggcttcaaaactcttagctaaggaaagagaaaagaaattctcacacgaagccaaatacctgaaagatactatataaaattaatttatttaaaagaggacattcaccttctgaggtctttttgttttgtttccatttagtagttttgtatcattcatatgtttgtatcattagtagttttgta

SEQ ID NO: 385702 - DNA, 139 bp, Homo sapiens
catgcctctgtgtggtctccatccatctcttgggcacctgcaaggggtttgacccaaggctaggcacttcccacatggtccagcattctttacttttctttttttcttttttgagacagagtctcgctttgtcacccag

SEQ ID NO: 385703 - DNA, 452 bp, Homo sapiens
aggcacatctcacatggcagcagacaagacgagagcttgagcagaaaaactcccccttataataatcctcagatcttgtgcgacttactgtaacgagaacagcacgggaaggacctgcccccatgatgcaattacctcccacctggtctgtctcacaacacatgggaattccagatgagatttgggtggggacacagccagaccatatcagaagggctctatctcagtcctgcccgtttgccctgaccttgtggccatggtggctgctcctggggaaaggcgggtctgcattcctccatagcctgagaggggcttatcttccccctgcttcccagtgttgcagaggggaagacaggaggtggaagaaaggggaggctgagagcccgaggagggcttgcaccctggcctgacccacgagagttcccttccctgccacacaagttgcagggctg

SEQ ID NO: 385704 - DNA, 580 bp, Homo sapiens
tgttaccttgatctttagtgatttgcagttttcaaggtgactctgtctttttatagtttagggtaatagcaagttcagtgagtaattttttaaaattagtaacattattttccgagcagtcttagattcacagcaaaactgagaaggtacagagactttccatattccccatgacccctgacatatgaatagcctccctcattatcagtaccccccatcagagttcatcagttacagttgaggaatctaccttgacagacacatcactcccaaggtccacagtttacattagggttcactcttggtgtagtatactccatgatattggacaaatgtgtaatggcatgtatatacccttgtagtatcatagacaaaatagtttcactgccctaaatatcctctgtcctctgccattttgtttcttcttctccactggcttctggcaaccattgttctttttggcgtctccatagttttgctttttccagactagtcatatagttggaataaaacagtggatatctttttgaatatttaaacaacaaatttccatagtaattggattctgtcattttagatg

SEQ ID NO: 385705 - DNA, 414 bp, Homo sapiens
ccaggaatcttggaagcaaatgcagcagatgagggaaaagcctgtagggatcctgccccctgccccctcccccacatagtttagatctgtgtcttctttgcatcctgaacagtggctgtactcttcatctggagcaaaggacctgctgtgaggcagtttcatttcctctgaggtgattggtaggttggtttattgtttggaccatcccttgagacactgaaagatttcttcctcattatgagagacttttaatttaaaaaaaatggatttggttgaggttctctgaagtggacagattaggagattaaaagactccttttatatgatttgactctgatagcttagtttgtgtttgtcaatgaaaactcttctccttaggccactgactgctctcaactgattctcaacacactt

SEQ ID NO: 385706 - DNA, 420 bp, Homo sapiens
gcggaggttgcagtgagctgagatcgcgccattgcactccagcctgggtgacaagagcgaaactccgtctcaaaaaaaaaaaaaaagaacctccttgggtctcttatgtggtaacttatgtcagtacattaatgtaggaagttagcaaaaactgctgaaacttcataaaaataatatttatgcacattaatttcatacagagaaaggcacagcacagcaacactatagtaaatcagtaagagctgaactaatgttgcattttattccctcaagtcactgtagtgcctagctctgacttccttctggattgaccattcttgtcatgggctatgctttgtgtttgtatttcagtcttagccatgtaagggtttgggtccaaaatatgatcttgttaatgtaataaaacgtaacaaaaaaaca

SEQ ID NO: 385707 - DNA, 319 bp, Homo sapiens
ccctaggccccaagggcacattgactggtgttagcaaggaagggaccctttgtttagaacgggtcagatgggccgtgggaaaaagagaggtgtgggaccgtgaaaggggactatggtgagaggccttcaaaggtggccaagccctcagacctaggcaaattgtgtctcagagaatgagggaagtcatgtgacctgaaagctgctgaaggtagtctttgaggaattgcagaccctcttaggggtcagaagactggattgtgagtaggccagttttcagtacagggaaaaaagcacagatcactcttttgaccccaatctt

SEQ ID NO: 385708 - DNA, 334 bp, Homo sapiens
gaaaagtcataaatgagcatgcatcactttttcatcagaaaaataaatgagttacatatttttttaaagggaagatattgtaaaggaatatttgttgacagaatgcattaaaaaacctaggtaatttccttatttccctgggattctgagaatttttttactcttgggaatatctttccttgctcttagttattttcatatgttagtcttgttcctggggataaaaaatggtaagtttgctatttgagctctgctcgaacatatggagtagttctctcttacatatacagaattggtttgacattcaaggtctttcagagtcaaatcccaattg

SEQ ID NO: 385709 - DNA, 772 bp, Homo sapiens
caatggggcacctgccttttctgtccccagaactgggaatgctggctcctatgcccctaggagagggcttggtataaaagctactttccacgagccaagatatgaggcccctgtctggtgttgctgagttgggcaagaggcttctcttctttgaccccaagtctaaaatagctaagctagagattctccaggggccagggctcagagaactgttcctgttgctgataatgatgtgccatccaagaacaggggtaccccaagtccctgccgaagtagcctgtaagtgctatgagtcataaatagagtgaccaatcactcctggttttcctcggacacagaacttttggttttaagactgtgatgggccaggagtgctggctcacacctgtaatacccagaactttgggagggccagggcagaaggattgcttgagaccaggagtttgagacaagcttgggcaacatagcaagaccttgtctctattaaaaaaaaaaaattaggaacaaataaataggccaggtgcggtgactcacacctgtaatccccacactttgggaggccgaggcaagtggatcacttgaggtcaggagttcaaaaccagcctggccaacatgatgaaaccccgtctctactaaaaatacaaaaaaaggccgggcgtagtggctcacgcctgtaatcccaacactttgggaggccaaggtgggtggatcacctgaaggtcagaagttcaagaccagcctggccaacatggtgaaactccatctctactaa

SEQ ID NO: 385710 - DNA, 918 bp, Homo sapiens
ggctggttttggccaagtcccatttgttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaacactcagctgtgcagatattatttgcactgatcccttactaatatttagtgagagaatgagatcgtgttaaagagtgtatatgtacgtgcccccaaaaggggtcagtgttacacaatagttgacaaataatatcctggtgcctaaggaaaaaaacctaaacttataaataaacttggctatctgaagacagcagagattgatgctgactaacacataacgaataataaaaaaggaaagtgaaaagggggctatagggactccagacctgtaacatctgacaaaggggattggcggtcctgaagttgaggaactactaatttaagaaaaatgtacttattttgttatccatgccttgcagctaagcaagatatgagttactgggtgtttcacaaaggaggatgtaaagaatgtacctttaacttgtctttaaaagggagggaggaagctgtcccaggcttttactgaagccagtaatcttgcagaacttgatttttacaggataatggaaattagtatcttcatatattactgtttgttccttgaacaagtagtaactggagaatttgtctccccatggccaaccctgaaatacaaaatccagataaatgctagaccctggggtagtcaggtgccaatactgtagaaactcttgcttagtttcagcattgtgttttagtgagt

SEQ ID NO: 385711 - DNA, 1915 bp, Homo sapiens
ttccaaaagaagagaacatggcagttatattgcccccctcgtctcccatgctagcaagtaggaagttcggacagtttcataacatggcccattcacaattccccattgaaatttagaggcaggtcaccttctatgaatacacaaagacactattgtggtcagaagtgagctggcttagtgaacacaattctttttatactaaaaaaatttttttcttaagaaagctaacaagtaggtgatggaaacaatgaataaaaaataactttttctagaacatataaataattttaagtgaccattgaaatgtaagtttagaattccaaggcaatttctgcagaggcgatagttacacaatcattctgttgaaagctaagatttagatggcattaggaggctgacacacagtaattactagtagtacttgttggcttgcagacaggtgggggttgggcctgcagaatcccctgcagcattttcctgtaatctggatgagcgatcttcaaacgtgtgctttcaaactacttaaataccatattcttcctatcttgcctttcatttttatattaccacagatactttcctcatagtcttgccagtgcttgtagaatgcttagaaaaagcttgataaaccactgggctaagtacacagagggagaggctagcagtatttttaaattggtttctaaattttttatagcttgatggtagataacacatttgcttcattgaagtaatctgaaaaaccaatcctcaaaagacctctcaattagaattcttaaatgacaatgttttctttatcatatatttgagagattgatttaaagaaaaataatgcttgactatctgaaataatattttaaccctatcataaaatctctgcctggtagaacagctgactgtggaagggtaaaatgcagagaaccagtcattggatctcccttctctactttgttactgaaatcttgaacctgtagaacattacttatcactgtgttcctttctaatgggaaaataataataaacacttgcagagtattttttaaaagtttttagctttaaaaaaaaaaaccctgtgccttacacaatgtgtatattgagttgatactgattatgataattagatggtattatacaatcattcattcagcaaacattcacttactgagcacctactaatgttccaggtactgattgttaaaaggtgattgagacacagcctctgtcctgagcttagtctagtaggaggtgacagatttgtaaataatagatttgaagttgctgagcaaaaaaaaaaacaaaaaaaaaaacctgtgtacctctcccccacagcaaatgtgtcacatttgcacagtgcccagcctttgcacagtgcccagcactcagctgtgcagatattatttgcactgatcccttactaatatttagtgagagaatgagatcgtgttaaagagtgtatatgtacgtgcccccaaaaggggtcagtgttacacaatagttgacaaataatatcctggtgcctaaggaaaaaaacctaaacttataaataaacttggctatctgaagacagcagagattgatgctgactaacacattgccctttttgagtctacagtttgaagttattttccaaaagaagagaacatggcagttatattgcccccctcgtctcccatgctagcaagtaggaagttcggacagtttcataacatggcccattcacaattccccattgaaaattagaggcaggtcaccttctatgaatacacaaagacactattggtgtcagaagtgagcttggcttagtgaacacaattctttttaatccaaaaaaaattttttttttaagaaagctaaccaagtaggggatggaaaccatgaataaaaaataactttttctaaacatataaataattta

SEQ ID NO: 385712 - DNA, 1861 bp, Homo sapiens
ttccaaaagaagagaacatggcagttatattgcccccctcgtctcccatgctagcaagtaggaagttcggacagtttcataacatggcccattcacaattccccattgaaatttagaggcaggtcaccttctatgaatacacaaagacactattgtggtcagaagtgagctggcttagtgaacacaattctttttatactaaaaaaatttttttcttaagaaagctaacaagtaggtgatggaaacaatgaataaatttagaattccaaggcaatttctgcagaggcgatagttacacaatcattctgttgaaagctaagatttagatggcattaggaggctgacacacagtaattactagtagtacttgttggcttgcagacaggtgggggttgggcctgcagaatcccctgcagcattttcctgtaatctggatgagcgatcttcaaacgtgtgctttcaaactacttaaataccatattcttcctatcttgcctttcatttttatattaccacagatactttcctcatagtcttgccagtgcttgtagaatgcttagaaaaagcttgataaaccactgggctaagtacacagagggagaggctagcagtatttttaaattggtttctaaattttttatagcttgatggtagataacacatttgcttcattgaagtaatctgaaaaaccaatcctcaaaagacctctcaattagaattcttaaatgacaatgttttctttatcatatatttgagagattgatttaaagaaaaataatgcttgactatctgaaataatattttaaccctatcataaaatctctgcctggtagaacagctgactgtggaagggtaaaatgcagagaaccagtcattggatctcccttctctactttgttactgaaatcttgaacctgtagaacattacttatcactgtgttcctttctaatgggaaaataataataaacacttgcagagtattttttaaaagtttttagctttaaaaaaaaaaaccctgtgccttacacaatgtgtatattgagttgatactgattatgataattagatggtattatacaatcattcattcagcaaacattcacttactgagcacctactaatgttccaggtactgattgttaaaaggtgattgagacacagcctctgtcctgagcttagtctagtaggaggtgacagatttgtaaataatagatttgaagttgctgagcaaaaaaaaaaacaaaaaaaaaaacctgtgtacctctcccccacagcaaatgtgtcacatttgcacagtgcccagcctttgcacagtgcccagcactcagctgtgcagatattatttgcactgatcccttactaatatttagtgagagaatgagatcgtgttaaagagtgtatatgtacgtgcccccaaaaggggtcagtgttacacaatagttgacaaataatatcctggtgcctaaggaaaaaaacctaaacttataaataaacttggctatctgaagacagcagagattgatgctgactaacacattgccctttttgagtctacagtttgaagttattttccaaaagaagagaacatggcagttatattgcccccctcgtctcccatgctagcaagtaggaagttcggacagtttcataacatggcccattcacaattccccattgaaaattagaggcaggtcaccttctatgaatacacaaagacactattggtgtcagaagtgagcttggcttagtgaacacaattctttttaatccaaaaaaaattttttttttaagaaagctaaccaagtaggggatggaaaccatgaataaaaaataactttttctaaacatataaataattta

SEQ ID NO: 385713 - DNA, 2058 bp, Homo sapiens
ttccaaaagaagagaacatggcagttatattgcccccctcgtctcccatgctagcaagtaggaagttcggacagtttcataacatggcccattcacaattccccattgaaatttagaggcaggtcaccttctatgaatacacaaagacactattgtggtcagaagtgagctggcttagtgaacacaattctttttatactaaaaaaatttttttcttaagaaagctaacaagtaggtgatggaaacaatgaataaaaaataactttttctagaacatataaataattttaagtgaccattgaaatgtaagtttagaattccaaggcaatttctgcagaggcgatagttacacaatcattctgttgaaagctaagatttagatggcattaggaggctgacacacagtaattactagtagtacttgttggcttgcagacaggtgggggttgggcctgcagaatcccctgcagcattttcctgtaatctggatgagcgatcttcaaacgtgtgctttcaaactacttaaataccatattcttcctatcttgcctttcatttttatattaccacagatactttcctcatagtcttgccagtgcttgtagaatgcttagaaaaagcttgataaaccactgggctaagtacacagagggagaggctagcagtatttttaaattggtttctaaattttttatagcttgatggtagataacacatttgcttcattgaagtaatctgaaaaaccaatcctcaaaagacctctcaattagaattcttaaatgacaatgttttctttatcatatatttgagagattgatttaaagaaaaataatgcttgactatctgaaataatattttaaccctatcataaaatctctgcctggtagaacagctgactgtggaagggtaaaatgcagagaaccagtcattggatctcccttctctactttgttactgaaatcttgaacctgtagaacattacttatcactgtgttcctttctaatgggaaaataataataaacacttgcagagtattttttaaaagtttttagctttaaaaaaaaaaaccctgtgccttacacaatgtgtatattgagttgatactgattatgataattagatggtattatacaatcattcattcagcaaacattcacttactgagcacctactaatgttccaggtactgattgttaaaaggtgattgagacacagcctctgtcctgagcttagtctagtaggaggtgacagatttgtaaataatagatttgaagttgctgagcaaaaaaaaaaacaaaaaaaaaaacctgtgtacctctcccccacagcaaatgtgtcacatttgcacagtgcccagcctttgcacagtgcccagcactcagctgtgcagatattatttgcactgatcccttactaatatttagtgagagaatgagatcgtgttaaagagtgtatatgtacgtgcccccaaaaggggtcagtgttacacaatagttgacaaataatatcctggtgcctaaggaaaaaaacctaaacttataaataaacttggctatctgaagacagcagagattgatgctgactaacacataacgaataataaaaaaggaaagtgaaaagggggctatagggactccagacctgtaacatctgacaaaggggattggcggtcctgaagttgaggaactactaatttaagaaaaatgtacttattttgttatccatgccttgcagctaagcaagatatgagttactgggtgtttcacaaaggaggatgtaaagaatgtacctttaacttgtctttaaaagggagggaggaagctgtcccaggcttttactgaagccagtaatcttgcagaacttgatttttacaggataatggaaattagtatcttcatatattactgtttgttccttgaacaagtagtaactggagaatttgtctccccatggccaaccctgaaatacaaaatccagataaatgctagaccctggggtagtcaggtgccaatactgtagaaactcttgcttagtttcagcattgtgttttagtgagt

SEQ ID NO: 385714 - DNA, 399 bp, Homo sapiens
tgcaatatacagtgctcaccaaatttattagacctgggaaccctttttttatggagcattttgagggaactgacttccatggattaggttagattatttacaaaatcccattcacatttaaagtatactaagtatatagttctcctggtcataaaaatccattttaataccattcatcatctagtcctttctatctggtcagtgcaaccagactttctgtatagttaaaaacacatccttgcctctagtcttcttttcagatgagcaacatatacagactagtgttctcttccttcaaagactcatgtcacttattgggaggctgaggcaggcagatcacaagatcaggagatcgagaccatcctggctaacatggtgaaaccccgtctctactaaaaa

SEQ ID NO: 385715 - DNA, 298 bp, Homo sapiens
ctgtacataaaataacttcagtggaatctctgcttccactgaggttttaattcttggcattttttattttaaagattagcaacttgtttcaagttagaggagatggcagggtcaaaattttagaaactggatcccaccaccactgtgttacttcctaaacctgcatcaaatgttctgccaacatgtaatgtgccaatagaattatacggtgtgaactgcatatctcagtatctccacagggaaaaaactgtggttggggcatggaggggggaaagggaaactcttctttaagttattt

SEQ ID NO: 385716 - DNA, 814 bp, Homo sapiens
agcggaatcaaaataatggcatttgcagcaacctggatggaattggagacgattattctaagtgaagtaactcaggaatggaaaaccaaacattgtatgctctcacacataagtgggagctaagctttgaagatgcaaaggcgtaagaatgacttaatggactttggggactcgagggaaagggtgggaggaggtgagggataaaagactacacactgagtacagtctacactactctggtgatgggtgcacctaaatctcagaaatcaccgctaaagaatttattcatgtaaccaaacaccacctgttccccaaaaacctactggaataaaaaataaaaataaaataaaatgtgagaaatgcaacacacaaaaaaaactaaaaataaaatatatttttatttaaaaaaagaagaagaagtcatagcaaagtcactcctggagcttctgtagggaagaaatttaaacaagaaaatgtatccttcagaagacaggtataaaattaaattatcaaaagtagtacaaccacctcctctcaccctagccactatcatcatctcagatgatcaattgtatctatgataaatcataaaattcaaaagtgctaactataaggcattaactcaagccttggctaaaaagcacaagtagagataatatgaatgtcctgattactcattctttcaaatatacacagcaagcatattctttaggaaggaacatactttagagatgtgtttttaaaagtcctatagttggcttactttagttactttaggaaaaaaaatcaaaaagttaacagagcaaagatatca

SEQ ID NO: 385717 - DNA, 565 bp, Homo sapiens
ctacactggttctcgtgtgttggttctgggtctgccatgtgggaggaagccttagcgcactctctgggggagccagaggtgtgatttttggtgcaacctgtgcgagctgtgtctttaggatgggcggaaaccattctgggtgctcgacttcaccactcccctcattgtaaaaggggctatctcattgtcctagacaaaattcttattgtaatatgctgtcagatgtgtgtgtctttccaagccagtaaacttttccagggatttcttcaagtagacagcattcagtgcaatcttcagcattgcagattccgagaaatgtggctctagatcctgttatccttgagaaacctaactgggttgcattaattccatatctccctgggtctgtggagtagtacatgagctcccgaagctctatctctcaggtctttttcagtccgaggcaggttgtgcagttcttagctttgaagggagtgattttttcgtgtgcttttgcctctttctgatggaacttgtacctgcggggggtctggagaaaaagagtagtagacttttgctttattgc

SEQ ID NO: 385718 - DNA, 617 bp, Homo sapiens
aagagtacgtctgtgtgtgcacgtggaaggggtgtggggagcacctcagagacaaaggtgaaggaagaggggatgaaagcagcacattcagtgggagtggtgagcactctgcacctgagccagaggttatctccccatgcctccagcaggaagataaatgacttgtctcactctggtacatctgaggcatttcaggaacacattctccaaacaatcaaataattctggctacaaatgtcatcgtgatgagaaggatcaatactggttagtttcaccaaccatctatataacactctattattttcaaatgacatttgattctttagagttgtaagtttttacatttacaaagacacacaaggactagccataaaaatatagacccattgtttgtaaaatgttttcacttgtttaaaaaggtactgtgaaaaaatgaagaaccagccagccgcggtggctcacacctgtaatccccgcacttagggaggtcaaggcaggtgggtcacctgaggtcaggagttcaaggccagcctgaccaaaatggagaaaccttgtctctactaaaaatacaaaattagccaggtgtggtggcacatgcatgtaatcccagctactcg

SEQ ID NO: 385719 - DNA, 273 bp, Homo sapiens
gtaggaaggcaggaaggaaggaaagaagaaaggaaggaaggaagggcggggagagaaaaagaaagaaaggagaagagaagagaagaaaagaaaagagaaaaaagacaatctagacagaggcaggaggccgacaagttaagaactgaaacaatattctcaatggtagaggttgccaacctatggtctgggggccagatttgtctgcaaagtgtgtttcatttggcccattcaatatttccgaattttgggaattcgtttcaaacatttaaaagt

SEQ ID NO: 385720 - DNA, 918 bp, Homo sapiens
caagattatgaccaagacttttccatgtcactttgtggtcccaaaagggtcaccagcaattccccaggcaactgtggtgagtttccctaaaacaagactaacctctgagccccaggtgatattcctgccctggtggacatctgttgctcctcttctgagagacgaacaaggcctacctgacaaggatgacagcgggatcctactgggggtcaaggttagaaatgagaagagctgtagcttgcttctcatcttctctgtctcggtcatttctgcagttgccaccgtctcatcctctctacttccccgagcaccctggagatacgtgtacagagaagcactaagcctgctcagctgtggcagtctgaagcctcacttcccacagcaccatgcatgcacctgcctctccagactgtgagctcccagcaggcagggaccccatgggccaggcagcctggcctgtgtcacagctacaaacaccaggccagagagacaaaactgcaagccagtgagcagaccccatgtcagtgggcataagccactcgagcctcccctgcctcggtagccagagcatagcctgaaaaagcacagggctggcaaatggggattcaaaggccagaccatgctcaaaaaacagcccaggcaaagcttgatggctcacatctataatcccagcactctgggaggccgaggcaagagcatggcttgagccaggagtttgagaccggccctggcaacatagcaagaccccatttccacaaaaaacttttaaaaattatctgaatgtggtagtgcctgcctataatctcaactactgggaaggctcaggtgggaggatcacttgagcctgggagttcaaggctgcagtgagccatggtagcaccattgcactctagcttgggcaacagagtaagacaccga

SEQ ID NO: 385721 - DNA, 457 bp, Homo sapiens
aatgttctgaagtttgctcttcattattaaatcattcaaaaaagagttcttcccattttgggggatggtggagtgatgaggaagtgttctaagggaggggtccatttgagcataaccatgtgtgagaaaataacaggcacttccttctttatggatcactgcactggaataggctggaaagtgctgggctggctgggtagatttgcatgatgcccaggtgtctaatgcagaactttccaaagtgtgttttgtggagccccagttcatgagctacttattttgtggacacgtaactttaggagaggctatgaatggcactccccttcgagaatatcccctgggcatgctctggtattagagaaagcctagagaagagactgtattaattctctagaccttagaccttatcagtctccctggagacaacaggtggagcccccttcctgtgggaggacaa

SEQ ID NO: 385722 - DNA, 240 bp, Homo sapiens
caccgcgcccggcccagagggtcttaattagtcatattttctaggaggagggcaacgaaccactgaattgagctaagaaacagtttctcagaaaaatgtggaatggctttcaaaatgttaggccaggttattacatcttttccttgagtagaacaccaaaggttggaaagactaaaataaggcattctgtgtttttttcttttggagtgccatgttaagaaattaactttttacagttat

SEQ ID NO: 385723 - DNA, 542 bp, Homo sapiens
gaatagttgtgtgacctggggcaaatgacatgtttctgtgaggcttagttttcctacctgtaaagagggcgttcacttgtgcctcacaggttgtgaggatgcgggtggtgatgggagaactcgcctggcaccatgtccctctccccaagtacatatttaggaagtgactcattgtgggtcatttttatgtcagggaactccctgaatattaatttgggggaagactggtggagttcaggcctgaggtgctgagaaacagtgtctgtggggacagtgtttgcagggtaagtgtcaacagcaggctgggcagatggatattagatagttttactgacttctcactcgcattcaggtgtacttttttgctaaaatgaaggcagtatgaaaagaagtgccaataactaacagtgggtttttgtggaccagattgctgagagaaggaatttgaaggagctgttgcttatatcttcagaaacacagtgtagctcttgtgccccttgttgaatttgaaaggccgtgttttgtaatcccttggaaaaaac

SEQ ID NO: 385724 - DNA, 417 bp, Homo sapiens
ttctcaagtatagagagatactcctgttcataggaaaattctaaatcttatttcaggtcttgactcagatgaagaactggggctgctctgtcaccacacgtcctatctaggtgattgtctggggctgctcgttggctcctgatatcctgtaaccttttctgtatatttcatgtgtctgcacgtctgcatggttattcacgccctgagggttgggggtgcacagcgggacatgtgtcctggctgttctgtctccagaaccttctccgggtttggggagaacttgagagagaggtccctctcctttgttctgtcagtcgagtcattatccaactattatttcatgcatagccagcagctttggcatttcttgggatgtggaaagaagaaagcaaattggctgtagcaaatccagtgtct

SEQ ID NO: 385725 - DNA, 126 bp, Homo sapiens
tgcttctccctcaccagcaccaaagcccactcagaaacctccgaaggatcattccaccagagagtggattgaggttaacatggcctctctgggttccgcctgatttcccattataggacttgaggg

SEQ ID NO: 385726 - DNA, 298 bp, Homo sapiens
ggaaggttccagcagaggcagggcctgaggatgaacaagagaaacagtgaggctatggggcagtggctcaagcttgtaatcccagcactttgggaggctaaggtgggaagactgcttgagcccaggagtttgagaccagcctgggcaacatagggagacattgtctgtactaaaaattttaaaaaattagctgggcatgatggtgcacgcctatagtcccagctacttaggaggctgaggtgggtggtattgcttgagcccaggagttcaagactgcagtaagctatgattgcaccac

SEQ ID NO: 385727 - DNA, 455 bp, Homo sapiens
agagaaaaggctattagaggggaaatttgtgaaattaaaaagaagatatgtcatttagttaacagaattctaaccatgttaattccttggttttgatcattgtactatcctcatctaagttgataatataaaggactctgggtgaagggtatgcctcagttttttgtactattgcagcttctctttaaacctaaaattatttcaaaatagaaagtaggccgggcacagtgggtcatgacagtaataacagcactttgggaggctgaggcaagaggattgtttgagcccagaagttcgagaccaggctgggcaacagagtgagaactcttctctacaaaaataaaattaaaaataacctggcatggtggcacacacctgtagtccccaacactccagaggctgaggtgggagactgctgagctgtgattgcaccacttgcatttcagagaaaagaa

SEQ ID NO: 385728 - DNA, 227 bp, Homo sapiens
aaaaaactgatagtttcaggcttttaaaaataagtctgaattcatttttataactttccttctttttaacatttttaaaatgaatttttattttattttattttattgttctatttttggagacaaggaatccctctgtcatccaggttgaagtgcagtggtgcgatcttggcttactgcaacctccacctcccagactcaaggattctcccacctcagcctctcga

SEQ ID NO: 385729 - DNA, 367 bp, Homo sapiens
tccaacaatttctaacaatccactttacttattgagaaaatgagtattttcaaagtgagtatctttagggttagagctttgactatcagaaacttcgtagaataagagcccaaatgttcacacgcatgcctataagagattcatgttttcacatcaataaagatcacacacacacaaaaacactaccattctctgaagaagtttcctagaaatgtagcaaacactaaactgtggatgaatttgtcataccaatctcaatttgttttcatgattatttttgtttatatatattcttatctcctgaaatcagacttgagtagatataaattctaaatttactatagaaaaagcaccacaccaaacttct

SEQ ID NO: 385730 - DNA, 1197 bp, Homo sapiens
atgggggtcattgttgcagggtcctttactcttgaggccctggtctcaagaattgagttaaataaagtcagtagtttctatgtgggcatttttagctgtaggccagaactaatgagttgtaacagatttttaaaaagatgtatagaacatttctgacttttgattgactctacatttattttttgcattttgctattttgaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtgttttatggtatgtgtccataatttaaaattcatgttatagtttcagtattaaggctgactttttttttttaagatatgtttgcaataagttaaaaaactgtaatacccttttgtggaaagctttagaaatgatataattattaaagatattaaacagactctgctgatgtaa

SEQ ID NO: 385731 - DNA, 1165 bp, Homo sapiens
agcgggacaggactacgcgcctggagtaggagaaggaggaaaaaagagaccatagacttccatcctggcctagagcggcccttaaagtgccagggagaggagggcgggtggggaccactccagaattggccgctggcggtatcatggcgacccggaacccccctccccaagactatgaaagtgatgacgactcttatgaagtgttggatttaactgagtatgcaagaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtgttttatggtatgtgtccataatttaaaattcatgttatagtttcagtattaaggctgactttttttttttaagatatgtttgcaataagttaaaaaactgtaatacccttttgtggaaagctttagaaatgatataattattaaagatattaaacagactctgctgatgtaa

SEQ ID NO: 385732 - DNA, 380 bp, Homo sapiens
  misc_feature (109)..(109): n is a, c, g, or t
  misc_feature (233)..(233): n is a, c, g, or t
ggactccgttcccaagaataagttttgcttgggcggaaagtatgtggttcatccgaaaaaaaagaaatcaatgatttgtggcagttcttcatgtgcttttgggcatttncatatcttccttggagaaatatcaattaagatccattgccgtatatacatatattaaaattatgggtcatgtattatggctcatacctgtaatcccaatgcttttggatgttgaggcgggaggntcacctgaggttaggagttcgagaccagcctgaccaacgtggtgaaccctgtctctactaaaaatacaaaagttagccaggcatggtggcatgcacctgtagtcccagctacccaggaggctgagacaggaggaattgcttgaaccc

SEQ ID NO: 385733 - DNA, 420 bp, Homo sapiens
atcgtgccactgcactccagcctgggcgacagagtgagaacctgtcaacataaataataaatcaatatctggcagcccttctctgttttactattcattttctgatttttcttctgtagtttaacctattgttctaccaaatgtaatttaaaatcattctgtgaaatccagcaaaaatagctttttattttaattttgattagatttgcattagagctcagtattaaaacatgcacaccttttggtgccagatttcatactcaacatactttgttccttttgtgcgaaggaaattatgtttattatggaaaacagtgaaagatgagaagtaaatggctcatcctccataaatggccatcgctgactgtttcatgtagaactttctggcctgtgcccatatcttctctcttcaggctttgg

SEQ ID NO: 385734 - DNA, 1294 bp, Homo sapiens
attttgatggacagagccattgaaaaccttgtttcttgaagttaagtttgatttgagaaaaggagtatacagatacttatatagccatatgttgccaactccttgccatttattcagtccacagcttgttcttgttctaagcatttattttattttctgaggtcattggtttttctcctaggatcaggtgagttaggaagatcattttttttttccattgaagaatgtagtgttttctaggacacagttcaaacttttgtgaatgtcttaagtcagtttctgatgtttctttcatatgagaacccttcatctatttgatgacagctctcatgtcccgtgatgtcacctctgctttaaataaacattcatgtttctcttacaacatgactttcagggtttgtttgtttgtttgtttgtttgttttcccctaccatcctgctctccctttgaattaggagactcaagggtataattgaatatggtttagtgttacctagcaaaacactggcagtgatcttacaaataatttagttatcagtccctacaccttgttttattatttctcgagcctaagacagtggttattgcatgaagatctgtggcccgttaggttacatggaaaggagtgattcatgaacagactaaaaattcagattatacaaaatatgtcaggttttgtttttgttttactttgtctttaatgtttgttttctactttgtttattatagaaatggatgctcattctagaatgaaaataatggagtttcaaaaatgtagctttttaacccagtagtagctttacaagataggttttgtatgctgatcagcaggagattctggttatctgagtcttcagaacattcgttcaggcattctgtactctgagagactttaagatcatggaaattaagagttttgaaagttctcaagttctcaaaagcatccttgaaaaataactaggaggtgagtcatttaatatttctgaacatctgatttctgatcgtaaaaatcaattaggaaaattaccactttgcatccataatagtaaatattgatttgggaaagaataatcattggatactaaattggaattaatagaaatttgacagagagcaggatatttgcatggtcttaaagcacttccctacagacattttgttaattgcaaggccaaaaaaaaaaaaaaaaaaaatagtaaccatatagtggaaaaactgaatgtcaaaattaatatcactgaggggaggcagacagatatcatgtgctttcaggtatgatactataagaacacaa

SEQ ID NO: 385735 - DNA, 368 bp, Homo sapiens
attgtcaccctctgcattgagctcaaatacccttctagaataaattacacaagtgcttctaaatagcagaggtcagtcactaagcagttttataagaagcttatgtaacccatgtgtgatgggaaaaaaccaaaccaaatcaaacaacaataaacatttaaacttcagagtactagctcagagcgggagtcaaccttaagaaaggacactggggccgggcacggtggctcacgcctgtaatcccaggactttgggaggcagaggcaggcagatcacaaggtcaagagttcgagaccagcctggtcaatacggtgaaaccctgtctctactaaaaatacaaaaagtagtcgggcatggtggcagtcgcc

SEQ ID NO: 385736 - DNA, 621 bp, Homo sapiens
taagtatattgtgtatacttaaaaaaaaaaaatcacattgtaactgagtaattagatagcaagagcagtaccagtagcatggtacgagagtttatttccttgttcttgtaattctccagctggtctttgtagcattgtgatagttgaatcaatagctgaacactaaaggtttaaaactaattttaaaactaattttgaaaacctgtgaagaacattgacttctggtgaaattcttgtttttcttaagtagcattttgacggtaaagtcattctcacagtaagagcatcattttcatgtagtttttaccactagttttccattttattaaaaagtgcctgtaaaagtctacttattgaccaggagtggtggctcatgcctgtaatcccagcactttgggaggctgaggcacgaggattgctcgagaccagcctaggcaatatagcaagacccccatctctacaacaaaacaaaaaaatagctggttgtagtgatgtgcttctgtagttccagttactctggaatctgaaatgggaggatcgcttgagcccaaacagtcaaggttgcagtgagttttgatggttccactgcactccagcctggacaacagatgggattctttc

SEQ ID NO: 385737 - DNA, 1228 bp, Homo sapiens
tggcattagattttcataaaccctattgtgaactatgcatgtgagggatctaggttgtgtgctccttaggagactccaactaatgcctgatgacctgaggcagaacattttcatcccaaaaccatctctctccttgccagtttgtagaaaaattgtcttccatgaaaccaatccctggtgccaaaaaggttaggaccactgagttgaagtactaacatatctttaaaacagaataaagtaggagtctttagtattatttgatgtgatagaatacatagtgaaaaagttgagtatttgatgtgatgagaataacatcttcacctgtatcagggaaatgtgaagataattcctatcaacattcactaaataattagcctcactttaaaaaaacgtagaaaacagaactgcaagattagtatattggaacaaaaagaatgcttcttgagtacttgtaactgtattttgaccaggaagaatatagtggattttaaaatgctgtagactatgggtgaacttaatttcttttaataaaatgagttggtttttcatgttttaacactgatgtacaatgaatgaaatgttgtactgacaccagtgttaaactattccatcttatctaagattgtggttaacagatggaaataatatactatgggttaacagtgaaatgtcttccctaatattcttttgctggaggacttaaactttcaataatttggagaatagttttctcatagtgactatcttaataatgattagataaggcaggtaagattgaaaggccacaacttagcagcaaatgttttacattcatttgagagccagtttgtaagtagttcaccaaaagatgttgggttaaagcagtggtttgaattaattgcatagcattcatataacagaatacaactcagcctaaagctcacaccctatatgaatctcatagacctcgtaagtgaaaaaaggtagacataaaattgtgttttgtatatttatgtattgtattatttcaggcaaaataaacctatggtgaaataaacacattgatagcctctggctgaggaagaaaagataggtgcctgggacaaaacacgagtgaattttcatcccaaaaccatctctctccttgccagtttgtaggaaaaattgtcttccctggaaaccaatccctggtgcccaaaaaggttagggaccacttgagttggaagtacttaacctattcttttaaaaa

SEQ ID NO: 385738 - DNA, 375 bp, Homo sapiens
gacggctcccctctcccctatggcccaggcgaatgcacgtgaacctttgccagacctttccctgtgggtagtgctcagctgcctcaaggcaacattcccagaacagaactgaactcttccccgggtccccgctccaccaacccagtcagttccacagtgtctgtgagtgataacgcaacatcacaccatcctccccaagcaccctgtcagaggcccggaagtcattccatgtgcctcgtccattaaggctgagctgtttaggctgctgtagcagaagggcatagactaggtggcttataaacaacagaaattaacttcccccagttccagaggctgtgaagcccaagatcaaggtgccagcagattcagtgtctg

SEQ ID NO: 385739 - DNA, 288 bp, Homo sapiens
caaattttctcagagataccctactcccttacctcctgcagaatcaccctaaacctttaaagttgattaaacctttaaagtccccaggttaggcccagaggcgctgactgtatcaactcaagacaagcctccagggtaaaaactattgttatgttcattctgtgtaagagaaaactgaagcagagaggctaaggaatttacactaggctacacaggaagtgagtggtagagctgggattcaaacacagcgagagcctccagagcccatcttcttttttttttttctta

SEQ ID NO: 385740 - DNA, 250 bp, Homo sapiens
ttccctggtctgagagtctggctgtgcagcagatgcattttggaggagctgaagctgaaagtgccagtgtggtgctggtgtgcatcactgccctctctgggatatctctgcagcagagcaaggttacagagctacatctgccgcagctttctgtgagttgtgtaaaaagactgtgccaaccagtggggagcttacattttcttatatgggattcctactattttaattaaatattgcttttagcagctct

SEQ ID NO: 385741 - DNA, 353 bp, Homo sapiens
aggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaagggttttctttttcattactaggtcag

SEQ ID NO: 385742 - DNA, 300 bp, Homo sapiens
taccattataccactgttttttcctttcagtatttaccagattaatcttacttagtttgtaggtcaaggaatcgtggatccatgtgtctgcaaataaacctaaagtcaatcaccaataaataaataatgaccatttcaagcaatggactgctttgtaggcactaaccacaattatcttgttacacgagaaaatccagtttcaaaactgcataagcaatatgatctcaattttttttttttttttgagagaaagtctcactctatcactcaggctggagtgcagtggtgtgatctcagctc

SEQ ID NO: 385743 - DNA, 476 bp, Homo sapiens
gagcccacttccacctctcgcaggctagacagcgttccccaagtccccccttgagctgggtgggctgcccagctgtgaacacaaggacacctccgatttcgtcctgtgaatgttgatattagtggtcccttccttcaggggctgtggggatctcaaaagataaggcaggtctggagtcctgcgcggtgacctgccgcatggcaggctctttacggacagcgcagggacgcactttgatgctgaaaatgagtctctgggacagatggatcccagtctgggtcctcgcaagcgctgtgcaccccgtcgccgcgagatggcggtgttgcgcccctccagcctcctctgctctgcgcttgggcgctgaatgttaaaattcctaacaggtgaatcgcttgaatccgggaggcggaggttgcagttggccgagatggcgccactcactccagcctggcgacagagcgagactacgtctcaaa

SEQ ID NO: 385744 - DNA, 872 bp, Homo sapiens
gcagatatttgaattggtacacacttgaagcacagagagattatgaactaaagcaaaatacagtcctatatggattttagctgatgtcgcttgagagttccactgagccacattcaacagtagttacagatttaaagatttatcattttctcattttaagatgaataccattatcacttaaaagtcccttttatttcattcattaaactctattaaaatcatagattgttcagaagcaatttttctttgaaattcttgattttgaaagcattttttatcattgagaagacacaattccctccccagatttgtgtcagtttccctctaactgggactcctagtaactttaaaaattattccatgagcagcacacaaacagtccccacccaggtgcattatttatttttttcctaaagatctacagtaaacataagacaaatgaaaaaaaaatcactatcaaattaagttcaggtgacctagccatttttagcatagagttatattccagaacctcaggttagcaaaactcacataggcagtcgaatctttgcttttcaaatttagacacaaaagaatctccaaagcaatggatgacattttatcatgtgattcccaataattaatttgttatgggcccacataaataaaataaatgctgagtgatacattgacttctgttatcgaaagcatctcccttctcactcctgcctctctggctcctgacattatttcttggttattggttgacagttcagtgccttgagtgttgctctcgctgtagggttagcaggataattgacaaaccacagggattgaatccctggattaggatgaccggactgtcaaaacaaccatgacaaactctcacatca

SEQ ID NO: 385745 - DNA, 376 bp, Homo sapiens
ctccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctgg

SEQ ID NO: 385746 - DNA, 1300 bp, Homo sapiens
agagtggttgaaagtaatttttaaaagaaaaaggttgctcagctatttttttcctattatatactcagaagatagctaaagaaaatgaatttaaattattagactgacataaagaacatctggtaaattctaaaatggtccactaaagaagattacatcctttcttttttggtgtcagcttagtttagatactttaaaattatcttggagatggtaaattagtcaggaatggtattatagaatgtttgaaatagaaggaaccactgtcccaattcttgaggtttgttcagagtgatgtttggatttagagcccaagtctccagattcccagtcagtaatgataatgttacctgttctggttccaaaattgtatcatcattctagtcatttttcattttaatgagttgttggacctactgatctgtttatggttacaaggggtagatgggagcatggaatactctctcagaagaaatgtgtaagtgcgaagtgagcggtgtagatcatgagtgcctggcaccctagaaatccttaagtgaattaaagaatacatacatatatatatatctttcattttttagggattttttttttcagacaaggtttcactctctcacccagcaggaacacagtggcacagtcactactctctgcagcctcgaactgctaggctcaagagatcattctgcctcacctctgcgccagtagctaggactacaggtgtgtccctccaagcccgctaatgggtttttttgagacagaatctcagtcattcaggctggaatgcaatagcacaatctcggctcattgcagcctctgcctcccaggctcaagtgatcctcctgcctcagtcccccaagtagctgggactacaggcgtgtgccaccatgcccggctaatttttgtattttttgtaaagacgagatttcaccatgttgcccagaatggccttgaactcctgggctccagcagttcgcccacctcagcctcacaaagtactgggattacaagcatgagccaccatgcctggccccacaaagtgttttgtagagacagggtcttgttttgtctcctaggttggtcttgaactcttcaccttaagcgatcctcccacctcagcctcacaaagtgctgggattacaggtataagccactggcacgggacatagaatttaagggggaaagtcagttattttgttttccctgttctttcattcccagaggtagctcttaactgttcttttgtgttggttcttttgaaaagaaaaaaaaaaaaaattcgagatagggtcttgtctcc

SEQ ID NO: 385747 - DNA, 430 bp, Homo sapiens
gatgaccccgatttgcatttcttgtcaccgtccatccgaccttgttaagacgagatttcaccatgttgcccagaatggccttgaactcctgggctccagcagttcgcccacctcagcctcacaaagtactgggattacaagcatgagccaccatgcctggccccacaaagtgttttgtagagacagggtcttgttttgtctcctaggttggtcttgaactcttcaccttaagcgatcctcccacctcagcctcacaaagtgctgggattacaggtataagccactggcacgggacatagaatttaagggggaaagtcagttattttgttttccctgttctttcattcccagaggtagctcttaactgttcttttgtgttggttcttttgaaaagaaaaaaaaaaaaaattcgagatagggtcttgtctcc

SEQ ID NO: 385748 - DNA, 929 bp, Homo sapiens
ccattccgagtggaccagtggtcctcctttctggaagctcttgctacaaagaaaagatgaggatattctatttcttgatccctctcagctactgggagctgctttgtgccttggaagcctcaagctgaaatggatgtcagcctcaagtttaactccaagagggttcaccttgtttctttgaacaaaatgtgctgcctgttgcttccctttgccaggagtggtgttcccttttccacaggtctggaccacagtgtctctagctcccgctcctggatacttggttactgtgtgtttcggtaaaaaagcatccacaacatgaatatccactaagctataacagggcctgctgcaactatagtatttcctgaaaaagtatcaactgccacaagggccacaaataaagtctgtgaacttgaaataaccatggagaatgaaatgttctgattcagatcatcggtgggatttcactgggaaatctcccactgggcaagagtagatgatggaggaggagaaacagtcactagaaaaaggtgatactttgtatcaagaaacaattaaaaattagatcacatcctgaaacattaagcatatgctcctttgtgaggcttgcctggctgaacttgaactggattgagtgaataatttcttaaaaacaatcaaaatcacagatttattctattttaaatacttatatttacttatatttcattcagaaattagttaacaaataatttttgagtatcctgggaactgttctaatcattaaacatgcaagtttgaagaaagtaaggatgaatctgcctgcgtggggctctcaatctagcgagaagcagataagaagacaaatgtcagggaagatcacacaaccttcaggtaatatttaagctgagacctcactagttgctaagactggatttcagaggtcaggt

SEQ ID NO: 385749 - DNA, 577 bp, Homo sapiens
ccattccgagtggaccagtggtcctcctttctggaagctcttgctacaaagaaaagatgaggatattctatttcttgatccctctcagctactgggagctgctttgtgccttggaagcctcaagctgaaatggatgtcagcctcaagtttaactccaagagggttcaccttgtttctttgaacaaaatgtgctgcctgttgcttccctttgccaggagtggtgttcccttttccacaggtctggaccacagtgtctctagctcccgctcctggatacttggttactgtgtgtttcggtaaaaaagcatccacaacatgaatatccactaagctataacagggcctgctgcaactatagtatttcctgaaaaagtatcaactgccacaagggccacaaataaagtctgtgaacttgaaataaccatggagaatgaaatgttctgattcagatcatcggtgggatttcactgggaaatctcccactgggcaagagtagatgatggaggaggagaaacagtcactagaaaaaggtgatactttgtatcaagaaacaattaaaaattagatcacatcctga

SEQ ID NO: 385750 - DNA, 464 bp, Homo sapiens
atacttagccacatttcaggtgcttagcagtgtcatgtagtggtcagctgctgtattaggaagttatagactatttccaccatcacagtttggggagttagtttgtagtttgcctctaaaatggtttatgacactggttcccatagggagtgattttgctccccatggagacattagagcaatgtcaggagacagttttggtcatcacagcttgaggagggggtggtgcaggctctggggagtggaaagtaggggatgctgggtaaatatgctgtgatgtacaggacagcccccaccacaaagattgattggggtccaaaatgtccgtgccacagctaaaacctgttttaaggacaaaggaagatctctacgtctgcatactcaccaggtgtaacctgttagggactcttcgttgcattagatcatgtgcacaggtaagtgaggtgttctgctggtcgaatact

SEQ ID NO: 385751 - DNA, 470 bp, Homo sapiens
ccagttttcacagatcgtctctcttcacagtgaaacaggaagcgaggtcagggctgagagctcaggatttgaggaatgcacaggatgcctggagctgcactcaaggaccaggcaagtggcacttggagaaaggaactaagccagcctccgcctcctcttctccagcccagttctccccagagcctctcccttgtcctcaaaccaactcttctcctcctcctcattgcctttctggcttgtaaagtgtttgaggctgggcacagtggctcacgcttgtaatcccagcactttgggaggccgaggcgggaggactgcttcagcctaggagtttcagaccagcctggggagtagtgagaccctatgtctacaaaacatcagaaaattagggtgtggtggctcatgcctatagtcatagctacataggaggctgaggcaggaggatcgcttgagggcaggaggatcactcgagc

SEQ ID NO: 385752 - DNA, 402 bp, Homo sapiens
atgagctaacaagcaaccaaaattaaaaatgacactatcacttttcactgataaacttccttccagaagtattgggaacgtcacaatacctggtgtttgtctggaattccgattaggtgccgcctgcatgttcctttagccccctgagccttcccacagatcacagcttcccttagagtcagtccgtgcagaaagagctgtgtcttagtgttcatggttgtattggtaatgccacatctagcagcatagtggtttcttagtaaatatttgttggatgaatatagtgctttatagtttcaataatgctttcatattcagtttgaatggttgacagctccatgaagttggctaatagtatcatcctagttttatagatgatggaacagaggttaaagaggctgt

SEQ ID NO: 385753 - DNA, 614 bp, Homo sapiens
gggaagatggggccggtagaggcagatagagggggatgtaatacacaggcactgagacagcaccccactgactttcccctgtccctcctccagctggcctcctcctttccaggggctgtacccaatccagaatcagttactcactggtgcccatcgaccatcatttccccatgtggccaccaaagaaatgaacaccacctttctggttggcatgatcatcaatttctcagccaaaacggcatgcatccttggctctgggaaacagtacatctcccaggaaagtgagcttacagcacggtaccccacttcctggttaccagactattgttcccgttttccccaagaacagtcatcattcacaggttgtttggcagggcccaggaacagagtcactctggttgctacagccaacagaccaaacacggcttccaggcaggaaggtcagagctgctctgcaggatgcacatgcaggttggaagcagacagggctggccgagcacagatatgctggctgtgtcctacacacaggtgcctacacacacatccttcagatccgggctgcactctatcagccaacccacggactctgttttttctaatttgcacagattctt

SEQ ID NO: 385754 - DNA, 624 bp, Homo sapiens
tctgtggttccaggctactatgggcccaggttttttgttgttgttgttgttgttgttgttgttgtttgtagtagaactacaaatattaaagtggaatttttttaaacaaggataattggtaaagttcagtattgataataatacatgactcccatgggcaccaaggttgtctgtaatcttcatagagaataagagctgaggctgggtgcagtggctcatgcctgtaatcccagcactttgagaggccaaggtgtgtggatcacttgagatcaggagttcgagaccagcctggctaacatggtgaaaccccatctctactgaaaatataaaaaaattatctgggtttggtggtgcgtgcctgtaattccagctactcgggaggctgagacagaagaatagcttgaatccaggaggtggaggttgcagcgagccaagattgcaccactgcattccagcctgggtgacacagcaagactcagtctcccttccccccacccccggcaaaaaaaaagaaaagaaaagctgattcagctttcaatttttagctactctaatatagaagaatattagtatagttaatctaaaaatagacttgtttttaaagatattttaagttttattaaa

SEQ ID NO: 385755 - DNA, 514 bp, Homo sapiens
ggcgctcaagtccatcaggagggaaccagcccatccacgtggaggtgttgaagagtcaggagcccgcgcacaggaggctgcctgggtttgaatcctggcaagttttaaactcactaagcctcagttattccatctgcaacagaacctgcctccctgggattgctgggaagattcagggagaaaacttgggtcaagccattggctcccaaataagcaaatcctccacaggggaagtccccaggctcgggctggagcccagggaggtgcggaccccaggggaggtcagaggcaaccctcacacaggactgttccacgttctgtttctgtaactcgggggccttcgcgcccgtctgcctgtgcacctgcgaactaattctgagcaactgtgcgctccctggcactttctgaagtcaaaatctgaacatttccaagtttaaatagttgcaaagagtatgatttccaaaatcatgtcaatattgccatcctaaaataaaagtgtgacatcattccttct

SEQ ID NO: 385756 - DNA, 957 bp, Homo sapiens
tatatatataatttcttttttttttaatggaagaaaaatacagcctgggcacagtggcttactcctgtaatcccaacactttgggaggccaaggcgggaagatcacttgaagcccagaagtttgagaccaccctggacaagatgatgagacccccatcactgcaaaaaaattttaaaaattagccaggcatggtagcatgcacctgtcatcccaggtactcaggaggctgaggtaggaaggtcacttaagccaaggaggttgaggctacagtgagccatggttgcacgactgtactccagcctgggtgacagagtgagaccctatctctttaaaaaaaaacaaaaacaaaaaaaaagtgtacatgtgcagtccagacattttttttcccaatatttttgatccacagttggttcaatccatggatgtggaacccacggatatgtagggccaactgtatatctgtgttcttttataaatatgttgggaaagatcttgtacagcattgtctggtgtcagccacatttaaattttttagtagccacattttaaaaaagaaagaaaaaaccagtggcattaacttcagtaatatttttatttaacccattatatctaaaatatttcacgtatttttatattcaaaatacaaacattactcaagaaaaaatgtcttaaatattggactctcttctaccttctaagctttataagcctcacagttattagcacgatgctttgctctgctcacataggcatcctcagtcacttcagtcaaagaaaccctaaaaaacaatggtttgttccttttactctggtaggcctgataagtcatgctaggtagcatagcattcattgtctagcttggaaagcattgcttcctatgacatggcattgtgactacacatctgttcatagaaatataaataatcactaagagcttgcatctagggtctgatacc

SEQ ID NO: 385757 - DNA, 900 bp, Homo sapiens
  misc_feature (28)..(28): n is a, c, g, or t
ctcggattcaactaacaaaactttctgncggtgttttctgaaccaccacttcaggataccattgttttttgtccttgtactactgtatgcttgtcatagtcagaaatatgtaatatttactgattaactaaattttaaaacttatctactctaaaggatgacatcaaggtgatacattttcattttaaggtttcatttatgttttgaataaaggcctattctctttgctaaaaccatttccagcctgggtgacagagtgagaccctatctctttaaaaaaaaacaaaaacaaaaaaaaagtgtacatgtgcagtccagacattttttttcccaatatttttgatccacagttggttcaatccatggatgtggaacccacggatatgtagggccaactgtatatctgtgttcttttataaatatgttgggaaagatcttgtacagcattgtctggtgtcagccacatttaaattttttagtagccacattttaaaaaagaaagaaaaaaccagtggcattaacttcagtaatatttttatttaacccattatatctaaaatatttcacgtatttttatattcaaaatacaaacattactcaagaaaaaatgtcttaaatattggactctcttctaccttctaagctttataagcctcacagttattagcacgatgctttgctctgctcacataggcatcctcagtcacttcagtcaaagaaaccctaaaaaacaatggtttgttccttttactctggtaggcctgataagtcatgctaggtagcatagcattcattgtctagcttggaaagcattgcttcctatgacatggcattgtgactacacatctgttcatagaaatataaataatcactaagagcttgcatctagggtctgatacc

SEQ ID NO: 385758 - DNA, 208 bp, Homo sapiens
tcaccagcatgagggtcttcagaataaagtaatctgctacttccagctcaggtagacaaacatcctacagaaatctgttctttgaccttggacaagtcacttaaatgtctctgagcctcacatcttttgtctgtaacatagagggaaacaatctgtcccttgtgtggttattgtgagaagagaatgagctacaaatataaaggtctga

SEQ ID NO: 385759 - DNA, 550 bp, Homo sapiens
gccaaaacgtgatgatgggcagctagcttggaaagaatgcttacaacgtgaaaattatatatttacaaaaggccattacttctgttaaagaacaatagaccccagtgaaaagaaaggaaattgaaaaatagagaaaatgtggagaaaactagaatctctatagacagcatcaatgcagcatcaattatgtgaaccacttttgagcacaaagaaatattgttttgaccttggaggcaatttggtcttcattaggtttagctgtaggatagttgatgttcattattccctataatgcttgtgatggcaaaaccttcacaaatttatatgatctaggtatgttttcaatccttacaacccaagtaaccgatcataactctcactatgtcatttgaaaaaaaaaaatgatcatcagaagtgtaattcaattagcaagtatcagtagtggagtataaattattggttaatactaagcatgatggaaaaatcatagtagatggaaatatgggaatctttattttggatgaataaactttatgcctaaaacatatgt

SEQ ID NO: 385760 - DNA, 1020 bp, Homo sapiens
gcttttccgtgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaacaaagaagagcaggctgctgctgagaaggcagtgaccaaggaggaatttcagggtgaattggactgctcccgctcctgagttcactgctactcagcctgaggttgcagactggtctggaaggtgtacaggtgccctctggtgccttattcagcaattccctactgaagactggagcgctcaagctgccacggaagactgggtctgcagttccacttggttcaggccactgaatggggtaggagcaaccactgaatggtcttaagctggactggatgggctcttaagcaacatggaaaaatggttgatg

SEQ ID NO: 385761 - DNA, 1172 bp, Homo sapiens
atatatatatatagatgtataggcttgtgagaaacttgagaggaagaagcatgctcttctaggaatgtgaggaaatatgaccttgccaagactaaaagacctctagactgtgagctcagttatggagaacaaaaacagcttcatagtgagtagaacaccgaggataaacactggggccatgggtcctttctgaggcagcgccacagaagatctttgtggtccttccgtagttctgtaagtctgtctcctaagtatgggtagagaatatgtagcctgttgtgtgtctcccactacttgtaaacagagcatcacattaggggcagggaggaggtggaatgatattggaggtgcttaaccctactcgaggaattaattatgaataaagagcttataattagctaacatgactagaaaacacatgacttaggtggagagttagctttcttttctagtttgtgtatgacttgccatttgtgacgtatacaccaaaagatctggtgttttagacttctgccattcacttggcatttaaatctctctttgcttatgctgttaacgagtatgccataggataggacaaattcagtaaacaggaaaacttgtccatatttgcatagacatttgtagggttttttttttctttttctttttagaacttcaccattggcttaagaatgtagttcccaaaacaattttttcttgcaaagtactttccttacacctcttggctacagggtgggccaaattaaacatatatgtattttcatttaatgtatgtgcagtttggtttatcatcttaagatggtggtgctgccccggtgctacttcatctgtgtacacaaagaccaatgcatggtctgtattgctaccaaaacatttactgtatatatgtttataacatgtattatgtatatatgtaatgggtgccaggccaggtatatattttttatttagaagtgtttcacttttccaagttttctttatagtgttatgcttattttcaattttttttttcctgattctgtctggtacttagaattgtagtgtcttcatcatcaattaaagaaaactgtctaaatgaattcatggatgtaaatattagtggtccttaatgtctttgattgctggacatgaaacaaactgccaattaaattttgcggagacatttgatt

SEQ ID NO: 385762 - DNA, 376 bp, Homo sapiens
taaatttaccagtttatttgagcaaagaatgactcaggaatcatgcatcactgagaaccaaaagttcagagtgctgcacagtgtgagcaatggacttttataggcccaacacagaagcagaggagaggaatcacctgattggttgggcatggtggctgatgcctgtaatcccagcaactcgatagacttactagggaggattgcttgagcccaggagtttgaggctgcagtgagctgtgatcacaccactgcactccagcctgggcaacaaagcaaccctcctgcccccaccctgaccccatctgctgtacttgtcagtaagcttgctttgggtttatgagatccaataaatatggattcatatcaaactgtttgt

SEQ ID NO: 385763 - DNA, 293 bp, Homo sapiens
tgaagtcatataaaagtttattcacttcttataaatatgttattatctttgattagtgatattttattaaaggtacttctcatttttattcatatttaaacataaatgtgttgatgaagatagtgatggtaatgttaaatcattggcttcttgagaattgtcgtagtcctggtatgtgagagaaaaaaagacaataaatgataagtgactcattaggataaaggatagaaaagagagcaagaaatatttgaaaaatatgtatttcatttactgttaaatatccagttcaatta

SEQ ID NO: 385764 - DNA, 591 bp, Homo sapiens
  misc_feature (584)..(584): n is a, c, g, or t
ccatggaaagagagagagatccagacagccccatcttcccaactgagccctgcctccaggtgacccgccaaaccgaatgctgtcccatgaatgagtccaggcaaaatcgacagaacaatgcagccaacccacagaatcacaagaacaattatttttgtcttaaaccaccatgattggggtagtttgttatgctgtgatagacacctgacacactaaggaagaataaatatgtccactgtagtcattcccaggcccaagagtgaacctgaggtcttgtacaccacctcacacagtaatggagaatgtgttggtgaacgaagctatccctgacatgcaaacctgagatcaagctctagattcattcaaactcatggtagttagctcattcagatccttaatgatccttacttaatgcaacataatccttatgtcaaggccattggaaatggctggcttcttcgaggagttcatcatgctgatggcgaggcgaacctgggcctcccacgagaagacgcacgagggtgacgagggccctgaccaccaccataagccaggcctcgccgagggcacccactaagaccacngtggcca

SEQ ID NO: 385765 - DNA, 154 bp, Homo sapiens
gcctccatgacactgaggctgaatgctacttgtcctgttttccttgattttcttggtctgcaacccattgttggtccaccacccaagctgatcctgctgtcaaaacatgttctactctttggcaggcactgaattggcttttctttaatgtccc

SEQ ID NO: 385766 - DNA, 298 bp, Homo sapiens
aaagagatttaacaccaggctatctttagcagaaaagtgaccaaagttcacaggattttggcataaggaattctggttgctataaatatttaagaaaaacaaaaacaaactcaagccagaatagcacccaaatactactttgagctgtactttagtgcactgaaacaatgatcaaaatgaattatttcactggttttcttggtaaagaaaaattggctaaaaatctatgtgtgatatagttttagttagaaaccagatttctaaaaatgagcacagaaacttataaaacagacctatg

SEQ ID NO: 385767 - DNA, 377 bp, Homo sapiens
aaacatgttacagattcagaatatccaaactgtatggtctcgtggggatggatgggacctaccagttgaaaataagaagtgggtgaaatagatgttagctacctggggagcacagctggttcgtctctcacagcaggaaattactgagctctttgttaatatgaaattagttccctgttaggtattttggaacctaccttagggtcaaatgaccaaaattaggcttgtaaaatacaaaataggtgtttaatgcatctttgaataaatgaactcccccatatattttaaaaaatttctcaacatcccccacctcctgatctgattctactttttcttttccttacattatctaggctgagccttgtttttgttggcat

SEQ ID NO: 385768 - DNA, 314 bp, Homo sapiens
aagtgtccatcaacagatgaatgggtaaagaaactgtggtatatatacacaatggagtactactcagccataaaaaagaatgagatctagtcatttgcaacagcatggatggaactggagataattatgttaagtgaaataagccaggcacagaaagacagacatcacatattctcgtttatttgtgggatctaaaaatcaaaacagttgaactcatcttctacatctactcatctttctacagagagtagaaagatggttaccagaggcctggaatggtagtcgggagattgaggggaggattaatgggtacc

SEQ ID NO: 385769 - DNA, 487 bp, Homo sapiens
tactcatcaattagagagttaattttctcccaaacactagtattattatatacctcctttctagcagataggcacgtgttaaactagcaatcattagtttagaaaccattaaacatcagaagtgcacattacttaaattgggaatgtttgaaattaccttttaaatctataagcaatttggttgttgcatatttctaagccttgttattgatatcaatagccaactaaaggagggaggacatacattagtgagtgttgataggactagaataaatttttgtgagcctgctttaaaaattttgttttaaggttaatatgaccctcagacatattaaacaggtaaaatttatataaacttaatagtagccataaaatagactcctgcaaacttctgggtttttgcagatctttataataggttctgaaaaagctgtttttgggggaagttttcatgcattctagacaagaccagtaatgtcagaaagca

SEQ ID NO: 385770 - DNA, 314 bp, Homo sapiens
agactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatg

SEQ ID NO: 385771 - DNA, 292 bp, Homo sapiens
gactattacctatttttaaaagtcgatatatttagcactgattcatattgtacattttgttcatttgatttgattttttggtttgtttttaagattttaataaatgatttgacccaaaaaaaaaaaacaaattaaaccctcaactgattaatatatgtttaagagatgattaacaaactcagagagaaacttgaatttgggatataactggctccatataatatatattagcatatattagcatctttgacatttagtctaatgaataattctctaggagaattattcattc

SEQ ID NO: 385772 - DNA, 420 bp, Homo sapiens
tcatctccagcgtaggatctggcatctgccttcctaggtttgcatcctggctctgccatcttgtagagtaggaagctgtggagccttgagcaagcatcttaacccctaagaggccctgtcagttgggggtagcaatgctgcctccctcatcatgttcatgtgaagatcgcaagagatactatgggtgaatcccagcacagtgccctagaaagctctcaccaagcatgagttgctaatattattcttattactgctcagaagggaaagggatgttttgaccaacagtgaataaattgagatgatgtagaagcaactacagccaagatggggaagtggctgcttcatctagagggtgataaggataaaagaaaatgtgggccaggcccggtggctcacccctgtgatcccagcacttccgga

SEQ ID NO: 385773 - DNA, 313 bp, Homo sapiens
tagttcaagagcacaacatactttattaaattctgtaagactaggatcagtgctgtaaattacattgaaatactgaggaagttacaatttttagaaataataaattctgacccctaagtaatctttgaaacaagctgttgcaaatttccaagcattcttcagtactttaaagtaataaaaacacaggaggatagatgcattagcactctaaagaatcatcagacattatgtagctgaaatttcctatgttacagaaatggacatattctcatttattttatgttctcttaaaatttatgtttctaaaactagt

SEQ ID NO: 385774 - DNA, 154 bp, Homo sapiens
agttgcagtctttttataacctaatattataagtgacatctcatcacttctgccatattctactagtttgaggtgagtcatttagtgcagcccacactcaaggggggagaatgacaaaagagtatggtgtccttcattgatagccacgccagag

SEQ ID NO: 385775 - DNA, 361 bp, Homo sapiens
gcaaaactgtctcaaaaaaaaagaaaaaaagaaaattcaaaattatttttaaataagtacattggtatttaatgtattttttgtttctatttatcattatagggaaatggtaggtgaattgtattgttactcttattagaaaaaatttcaaagaaagaatctgaaatgaaatgaattgtaaattgcactgaatatttgaaataacctttactatgtgtttctatgtgttttctagaaataggtcattttctttttgccctcaagtaaaaaatggaagttctcctttaatttcttacttttcttcaagaggtaaacaaactcttcaagaatttggtgtgcaactttgatttttttttttttt

SEQ ID NO: 385776 - DNA, 174 bp, Homo sapiens
atggagccccaggacatggagggtgcaggaagagcaggtcttggtgaccgatctgttttggagcaggtgggagaggttgaagataaggaccaagttcctggtttgaagaactgggcagaagccacacaccctggctcatagccataatcccatcaactccagagattgaggtgg

SEQ ID NO: 385777 - DNA, 377 bp, Homo sapiens
ctgccttctgggtacccataaccaagctgctccccaccacagcctctgccttcctatttcgtcaagagcacaagctttgcagtccagttcaaagcccagctccaacgtttcctaatcatgagaacttggacaagtcatgtgactatcctgaagctcagtttcccatctgtgaatggggaaaagatcacctactttacacgatccatgagaggattaaaacaggcaccaccactatttagaggctgaaaaaatgggtagctaccaagagctacaaaaagtctatcctgcagagctggggcaattgtcgagcacggtgtgtttgggaagacagcacctacacacatcaaatgatttccacctaaaacagcttcctgcag

SEQ ID NO: 385778 - DNA, 329 bp, Homo sapiens
tttgcgaagaaaaattttagtttataaacagtatactgtatctggtcacatggaatgagaacatattcttcctttaaaggttcttttttctagattagagaaaagagcttttgaattcctttggagaaatgatggtatggtcagttatgtttaatattttgtgcctggagaaatacaattgatttggttactttatttaagtgtctttctgaggaaaatgcactgattccttaataaaatttgtgttagattttagtgtaaaaacaaaactcgtgaaataattttatatatgaacaaagtgctagtgattatggtgtcatagatttgcc

SEQ ID NO: 385779 - DNA, 124 bp, Homo sapiens
agcgttatagtcgtgagttctgatctatccagtgcgtaactgtgaacttgagaagtgtttctgccaaatcgaaagtttattttattttattgttattttaatttatttatttgcagtggggagc

SEQ ID NO: 385780 - DNA, 348 bp, Homo sapiens
aatagtttaatctcaattttacttaattagtaaagattttccataggataacagacatgtatgcagttaaaagccagaacctatataaactgttagtgcacctgatgcaattatgagttaaattatactgtggatcctgtagaaaaaatatggtttcatttctatgaaatgaaattgttttacttagcatttcttaaggcttacaaagagaaagctttttcagctttcggttcaatagttgctatcacactaatgaagttttggtatctatcttatgttgaattcattgtgatttagatacagatttagacagtgttttgtcatttatttggacttcagagatagagt

SEQ ID NO: 385781 - DNA, 292 bp, Homo sapiens
tcctgctggatgctgttagcagataacagtctcagtgcacctgctaataatgtttacctctcctgggagctgatctgacacaattttaggaagctagcagtctcacaaaacaggagtctagaaattgagacagttcagtgagattttcttatcaggaaactactcctggaacaaggcaagatataagaaaagaagagattgtttaaagaacaggaagttaacaaaaaatccaggaagcagttggaccatcgtaagagtgctcagaacttcaagggggtggaaaggcccctat

SEQ ID NO: 385782 - DNA, 923 bp, Homo sapiens
acacaggagccagatcctaaaggctttgtatgccacattaggaaagaatttggaatacagcttctgtttggaaaacattttctgtaaccagcccgacacagagacggggttttgcatgttggccaggcttgtctcgaactcccgacctcaagtgatcagcccgccttggcctcccaaagtgctgggattacaggtgtgaggcaccgctcctggccaagaccaatatttcttgacgctgacttcaggagctagcacagaactggttggagcccagctaaactaaaaagcacagccaagggcagcaaagccttctatgtttacagagccaaaaggatgccgaaggccctggaagttgaaaatcaagactggctgctgtaaagcagaccatctcagacgtattctcattcctgacaaatacccacccaccagcaggactgggagacacatggcaaccagagcaagttgtcaaaacttatcattataaaacgtccatcttacaaaagtacaacctttgctcagtgcagtgttttccttagaagacagctcttctgagagctataaaaaggtggttagaatgggtgaggttagctctcgtagtctaagctaacaatcatgttaaaaatgtaaaggtgaataatgatggcagaatgttttacaaacaaacaacaacaacaacaaagaaattcattaattatgttcctctacttcaaagaaattcataatttttagcactgctcttttgagaaaagaaaattgcctgtaagatctctggcccttctcctttaatttcctttcttactccataccctcaggtggctagcctagtgctacatggcctaggctacacataaagttcacagctctttgcctgatctcctgatcctctatcaaaacagcactttcaaaagtgtttcctgtctagc

SEQ ID NO: 385783 - DNA, 691 bp, Homo sapiens
ctgaaactgaagatcggcacctccctaaacaggatgctctccttttctccaacagcacagccaagggcagcaaagccttctatgtttacagagccaaaaggatgccgaaggccctggaagttgaaaatcaagactggctgctgtaaagcagaccatctcagacgtattctcattcctgacaaatacccacccaccagcaggactgggagacacatggcaaccagagcaagttgtcaaaacttatcattataaaacgtccatcttacaaaagtacaacctttgctcagtgcagtgttttccttagaagacagctcttctgagagctataaaaaggtggttagaatgggtgaggttagctctcgtagtctaagctaacaatcatgttaaaaatgtaaaggtgaataatgatggcagaatgttttacaaacaaacaacaacaacaacaaagaaattcattaattatgttcctctacttcaaagaaattcataatttttagcactgctcttttgagaaaagaaaattgcctgtaagatctctggcccttctcctttaatttcctttcttactccataccctcaggtggctagcctagtgctacatggcctaggctacacataaagttcacagctctttgcctgatctcctgatcctctatcaaaacagcactttcaaaagtgtttcctgtctagc

SEQ ID NO: 385784 - DNA, 112 bp, Homo sapiens
aggttggatgcatttacatttttggttattgtgtgttaagtgaagatttggcaactgctggtatttatgccagtgggttggcaaactaggatattttacccaacgctgtgga

SEQ ID NO: 385785 - DNA, 236 bp, Homo sapiens
tgggcaaatgagtgataccctgtctcaaaaagacccccccaaaacacaaaaaaacaaaaaccacatatctggttattgttaccaagtgaatcacagctaaaagggtggtgatgtgaagactcgagaacatgatgctataatactacaattcaggccacgtctccatttattaaagtatatttcactggaataattttgaacagtgagctttcaagcataacgattctacaactgtt

SEQ ID NO: 385786 - DNA, 739 bp, Homo sapiens
aggcgctgagagtatgtgcaaaggtccgtggacggaccgcattgcttgttgttgcgcttcggaggcggagatccccgaaggcgagctgaaatacggctggagagttcccaggatacaatttgcagcagacgagtatggaagactaccagccggagtggtggcccaccctcagggagcgcttgtgctccgacggcttctcatttccccaataccacattaaatcatctcatctgaggaggatccacagagctgtcttctgtggtaatctggagaaactgaactaccttctgttcacgttatcatgacgctgcctgagtagttgtcgaccttgttttcacattaactggctgttttgttgtggctgcacttctgtttcattaccttcatcagaatcatagcttggaggcttcatagctccctgattcaattctgtcccatatttcaacttgtggtatttggctcttttctgtttaagagcatactccaacattctgatcatcctcacgagatccttcttcaaattttcttggcccttcctttctccctgtaggaaggcaatctgggccgtaattgttgatgaggtcttggagcctcccttctgctcccagaagcttttgttgctcatgtctccagccacaatatccttgcaggacagagtcttggctgcagactgagcctgtacctcacccgtctcccaccgactcttggtactggccacggccatgctgggcagctctat

SEQ ID NO: 385787 - DNA, 377 bp, Homo sapiens
agcctgggcgacagagtgagactccatctcaaataaataaataaataaataaaataccacaactttccaagtttctgagagacaagagacaaagggagggaggaagagaggaaagggggaaaaagagagagagagatcagttgataggagcagcagcaaccaggccatgctggcaactggacagttgttatagcctcttgagatgtgtgaccatcaaccacgaatgcagatatttccaaagttccatttttttttttccaggtggaaattgctggcatggaacagatgcctttatttggagaaaacagtctttgtaaatgattctggttctgtctcctcttattccctagagagagtctttcccagatgaaattaga

SEQ ID NO: 385788 - DNA, 133 bp, Homo sapiens
agaaagaaaaccaaggctggagaaaaactatagaatgtaattggttgaaacatcattgattcaacacattgctaattcttcactcaaattacagcaataaactttcaaatgcttccactgcaaacaagaaagc

SEQ ID NO: 385789 - DNA, 379 bp, Homo sapiens
aactgacatccatatactctttccttagaaacaagttgttaatattttgccacattgactttttttcttccacatatatacctatcccgcttgaatcatttgaaagtaaattgctgacatgacactttaaccctaatgcttcagcatgaatctaagaatgaggatattctcctatgtaaccaaactaccattatcctacctaagccaattagcagtgattccatggtatcatctaatgtacaatttgcattcaaaatttcattattttcttaaaggctagcttttttttaaagtcaggatccattcagacttcacactttacatttgatctatcactttagtactaattgagaactgtcttctcttgtttgtttctata

SEQ ID NO: 385790 - DNA, 6149 bp, Homo sapiens
  misc_feature (2527)..(2528): n is a, c, g, or t
  misc_feature (2794)..(2794): n is a, c, g, or t
ggttggctcgcgggtaggcggccccgccccccacatccgggggccggggccgggctgtgggcttgccgcgcgcgggtgagtcaggccgggttttccctccgcctttggggcaggcgatcgagcgccgcggagcgcgtccctccctcgccaatccggctccggcgccggcgcccgcccgcgttttcccggcgcctgccgctccgccgctccgacccggcacgcagtcccggcccgagccgacgccttgcaggagggttcaaatccgcgcgggggagctgcgacgcgcaagggctgcggagccgcgggccggcgagcgcgtcgccaccatgaagcagctgcctgtaccctgttgaaacttcatggccacagccccaggccctgctggcattgccatgggcagcgtgggcagcctgttggaacggcaggacttctcccctgaagagctgcgggcggcacttgccgggtctcggggctcccgccagcctgatgggctcctccggaagggcttgggccagcgtgagttcctcagctacctgcacctccccaagaaggacagcaagagcaccaagaacaccaagcgggcccctcggaacgagcctgccgactatgccaccctctactaccgggaacattctcgcgcgggtgacttcagcaagacctcgctgccagaacggggtcgctttgacaagtgccgcattcgcccctcagtgttcaagcctacggcgggcaacgggaaaggcttcctatccatgcaaagcctggcgtcccacaaaggccagaagctgtggcgcagcaatggcagcctgcacacgctggcctgccacccgcccctgagccccgggccccgggccagccaggcccgggcacagctgctgcacgccctcagcctagatgagggcggccctgagcccgagcccagcctgtccgactcctccagtgggggtagttttggtcgcagtcctggtactggccctagccccttcagctcctcccttggccaccttaaccacctcgggggctccctggaccgggcctctcaaggacccaaggaggctgggccaccagctgtgctgagctgcctgcccgagccaccacccccctacgagttctcctgctcctctgccgaggaaatgggagccgtgctgcccgagacctgtgaggagctcaagaggggccttggcgatgaggacggctccaaccccttcacgcaggtgctggaggagcgccagcggctgtggctggctgagctgaagcgcctgtatgtggagcggctgcacgaggtgacccagaaggctgagcgcagcgagcgcaacctccagctgcagctgtttatggctcagcaggagcagcggcgcctgcgcaaggagctgcgggctcagcagggcctggctccggagcctcgggcccccggcaccctcccagaggctgaccccagtgcacgaccagaggaggaagcccgatgggaggtgtgccagaagacagcagagattagcctcttgaagcagcagctgcgtgaagcccaggcggaactggcccagaagctggcggagatcttcagtctgaagacacaacttcggggcagccgggcacaagcccaggctcaggacgcagagctggtccggctgcgcgaggctgtgcgcagcctgcaggagcaggcccctcgggaggaagccccaggcagctgtgagactgatgactgcaagagcaggggcctgctaggggaggcaggaggcagcgaggccagagacagtgctgagcagctgcgggctgagctgctgcaggagcgacttcggggccaggagcaggcgctgcgctttgagcaggagcggcggacttggcaggaggagaaggagcgcgtgctgcgctaccagcgggagatccagggagggtacatggacatgtaccgccgcaaccaggcactggagcaggaactgcgggcactgcgggagccccccacaccctggagtccccggctcgagtcctccaagatctgaggccagcagagcgagctgacagcagcaacactgtcagaaggtgccctgagacggccggctcagccttcccttgcactggttggggtggaacctgcagaggccagcccggggctggggaggcgcaaggagaggagggatccagtggggccgtgggctgggtagggtgccttggcaggagccaggacaaggccctcctggcagaggagcacctaggcagggcccagccctgcttcctggagtggatgtggcccagagaaggaggctgggggatcaccagccccaaggtcccgaagggcaggtcagagggagagaggctggagacctgggctggagccttcctccagggaaggaggctggggtgggaacactggcctcccccagaataaaaccatgttttctaccagaggctcagaatacgctgagcctgtgaccagaggatgatggatggtcgggattgaggctgttgacctgggcagtagctcctcccatggccagtggtcagtgggagggtgtgccctgcgcctgtctgcatnnccactgggcatgtgtgttgggagcagaggagtcctactccttgcctcagccccacacggttccttagctgccgtgtgggctgaaattcctttctttagcaccagtggagttttcagaaggaacaacaccagggaatgccaaaaaaacaaagggcaagtcaaccaaggcattttgagaacatgaaatgtcttcttggtgggaaggctgggccccaggagtatccacaggctcaggccatgcccctccccgcacccacctcctgtctncctccctccctccataggagtggggggcccctagaagtgctctgcctcattccctgttcgtaggaaggtgcaggagaggaggtgggcaagcttatgggtttcttggtaaagagcctttaccacagcaaggaatgggaacatttccccatcagcaacggggctctagggcattattaagtaggggtgaaatatgattgatttgcattctggaaagctctcccaggaggaagcattccccaccccaccttgcctctgtcctgcgctgggctccaggacggtcagtcctcccagatccctgctctcagctaaggctggtccctaaaacccacacctgcctttggtctctcagaggcctggcttgccctctgggcctttgctcccccgctgggtgcccggcctggaacacaggttctgtctggctgtgtgagtggcgtctctcccttcctttgagggaagctcagctttcttacgcgctcatcgttggacgggctgccatgcattgcgtgcttactgggcgccaggtgctgtgctgggcccttgtgagtgtgggggcacaggctgaattagatgagctcctgccgcagggggccctgcacactgatgtcagctcaccagtctcttccctgacagggcagctcagggaacttctgagaagttatctgcagagagccccccctcactccctttggctaccctggccgtgcctggcagcccctcaggccccacaggtgggtcctggttgtgaagtggagttagtgcacatggatgtcaggggacgggtgtgaggcatgagctgggggggccccctttttcagggcagagaatgaggcgtgtgcactgtctgctgtggggatggtgtgtttatggccatgtaagtggcaggtgtgtgtaaagatgtgcttgtgggtggtgggtgtgtctgagggggtgtgtttgggagcctggcctccaaaagccagtgtctgggttggagacagtgcaggccccttcttggccccaccctctaccccattccttcctgtcagccccagtctgtcttggcactggccaggcttgggtggagcctgtgtcccagacagatcccctaggcctatctgagacccatgcaggcccacacctgagctcctgtctgcctgaggagggaaagggggagtggccaggtcaggcaggccagtcgtctacacacccccttggtacccattcccatttcacaaactcctccaaaccccaaaccccaaacggaaatctctgggacaatggctcctccagagggcccctcagagccaggtgctggccagatgccttgatcacagcctccatggccaggggcctgtcaagccaggggcccacatacctggtgccagggcccacctcggtataccagctcggcagaacagttccccacccagcgattagggagctgggctggccagtacagccagtggggagtgggtgggaggcaccaaaacttggcagctgtgccagaaaccaaagccaggcccagatgtagggggagggcacgagagctgaacctgagcctggggcgtctcggagctggatccccgtcagctcatccaggctggacaaaccagttcctgggtcccccagccggctgggtggctctggggccaaccgaccacaggtgtcactgatcacaggtgtcaccgtagtggctaccacctcagggcagcccctccctccagctggcggggcctcagcttcccagctgccctggcttagccttccctgcagcccctccccaacaggcttggtccgggcagcctgctctgcggaaggtggcagcctcctggtgctgggctccctgcctctggggcctccagtccttcactcagtgtcatcccttccagcagctccctgggcctcttggtccatcccttcaggcttctgacacactagtggcctcgagtcactgatagtggtgcctcctccttaccttggcaagcccttgtagccctctgagccctcatcctgcaggcagagcccctcagtgctctgagaaacctgccctgaactcaccgcctcccctgcctgggcactccctcctccctgcgcccacagcccccatgccaatctccgtcagctctttctgtgctgctgtaattgttggtttgcctgtctcctttgagctgtgggcattgccggggtagggtggtgtcttcaccacagctccagaaggcactggtgggatgtggagtcaggagcaaccagagaccccccaatactagaatgggtttgagcttggggtggggtggatggggaagacttactctgaatgttcgttcaccatccgtgggcaccaggtctgtgccaagcacagggactccaggggcagctgccattcgttccagtgatgtatttggggccttctcaggtgaggaagccaaggtggccaaggccctcggtcccctgccctgatagggcttacctgtgggtgggggagggagaccacacatgtcagaggtagtgaaggccgctccaaatagtgactggggccaggcaggcggaaaagagaacagaagagaatccagaagtgttcagacagaactagggacaacagaggggcctccatggtggcatgggtcagcagagcatggagcaggcagaggaagcctatctgtggggctgggtacatttctctgagactcacggaatgtaagtgttgaggtttctgcaaagagggcgcaggccctgcagtgacggttcagatattgataacccatcccccttggcaggtgggggcttaggcatccatattggattcagaaaagaaaaagaatgatgcttcttgcaacaaaaacaaaagtgattatgtcacgagaggagaggctggagggccatgggagttcccagctggctcactcatccgtccaggaggtgggtctcatggtttcattttgctttgggcttacttagagttttggcaaatgcagagttatgtaacgaacccaacaatgaagatacagttctgtcacccccccagcattctcctgtggccctctagtccaccccccgccccaccccagcccctggcaaccactgatctgctttcacaataaccgtatggggttttttctctttccttttttgtgagcggtatttaattcctttgctctaatatgtaatattagaacatattacaaagtagcaagaaaaatacgacattggtgtaaaaataatctacacctcatggaaagaatgaagagccagaaatagattctattctgtagaaaatcttacacaataaaggacttcaaaataagggtaaggaaggatgctttaacaagtggtgctgggataactggataaaaatttgggaaaaaagtcatactatgtg

SEQ ID NO: 385791 - DNA, 1433 bp, Homo sapiens
actagagatcctgcaccgatagcccgacaggccccgaccagcccttgtagccctctgagccctcatcctgcaggcagagcccctcagtgctctgagaaacctgccctgaactcaccgcctcccctgcctgggcactccctcctccctgcgcccacagcccccatgccaatctccgtcagctctttctgtgctgctgtaattgttggtttgcctgtctcctttgagctgtgggcattgccggggtagggtggtgtcttcaccacagctccagaaggcactggtgggatgtggagtcaggagcaaccagagaccccccaatactagaatgggtttgagcttggggtggggtggatggggaagacttactctgaatgttcgttcaccatccgtgggcaccaggtctgtgccaagcacagggactccaggggcagctgccattcgttccagtgatgtatttggggccttctcaggtgaggaagccaaggtggccaaggccctcggtcccctgccctgatagggcttacctgtgggtgggggagggagaccacacatgtcagaggtagtgaaggccgctccaaatagtgactggggccaggcaggcggaaaagagaacagaagagaatccagaagtgttcagacagaactagggacaacagaggggcctccatggtggcatgggtcagcagagcatggagcaggcagaggaagcctatctgtggggctgggtacatttctctgagactcacggaatgtaagtgttgaggtttctgcaaagagggcgcaggccctgcagtgacggttcagatattgataacccatcccccttggcaggtgggggcttaggcatccatattggattcagaaaagaaaaagaatgatgcttcttgcaacaaaaacaaaagtgattatgtcacgagaggagaggctggagggccatgggagttcccagctggctcactcatccgtccaggaggtgggtctcatggtttcattttgctttgggcttacttagagttttggcaaatgcagagttatgtaacgaacccaacaatgaagatacagttctgtcacccccccagcattctcctgtggccctctagtccaccccccgccccaccccagcccctggcaaccactgatctgctttcacaataaccgtatggggttttttctctttccttttttgtgagcggtatttaattcctttgctctaatatgtaatattagaacatattacaaagtagcaagaaaaatacgacattggtgtaaaaataatctacacctcatggaaagaatgaagagccagaaatagattctattctgtagaaaatcttacacaataaaggacttcaaaataagggtaaggaaggatgctttaacaagtggtgctgggataactggataaaaatttgggaaaaaagtcatactatgtg

SEQ ID NO: 385792 - DNA, 348 bp, Homo sapiens
aaccaaaccaatcagaagattttgaggacaatgtagcacaaaaagcagatatgatttgatttgcaaatatcactgaaggggcttatccacacagaagaaagttccattattgcgctgtcaccaacaatagaattgagagttactatgaagaaacacacccattttcagacaaggaggcaatctgcaactggcaaatgggccatggcccaaagcgggtaacacaacatggaagtgcagatttgtttctgcatctcaggctctcgttaagtcaaaggaaaaaaaataccaaacattatttatgataaattcacactaggaaagctctcctttgatatttctgaaattcag

SEQ ID NO: 385793 - DNA, 248 bp, Homo sapiens
caagcaatcctcctgcctccgcctcacaggtgtgcaccaccatatttgtagttttacttctcctgtgagactttaacttctcaagggtcttttctatgccttgtctttctctgagtccctaaaagtgctcacagagcacatacaaatatttgagacgtaattaaatgaagtgacaggtctttagatacagaaatgcaggacacaggcagaagtctgggtaacctgtgcaggcctggggctggggagta

SEQ ID NO: 385794 - DNA, 1750 bp, Homo sapiens
gagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgctttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggccaagcagtcggctgatgaataagctgattttgatggggttttgggatttgagattgacgcggtgaagcctgtccagttttctaaccacacacggtctatgccagcat

SEQ ID NO: 385795 - DNA, 2218 bp, Homo sapiens
gagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgctttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgtcacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacccctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaacccatg

SEQ ID NO: 385796 - DNA, 369 bp, Homo sapiens
atatgtaataaatatgtatggagtaacatgtaacatgtaaggaagtgtaaaacttgtaagcctttgtatgtccacactttataccttagcttgagatgttgaatcatctcctttcatgaggtggactttatgagatcagctaagggtctcatgactttgccggactagtctcagtcttcaataccttacttagggaatcttgcaaaacatgttagaagaaatgaggtggagatattgaccaaattttattgattacatttggttattaggccagaaatataaaaatccagaaaagagctgggtgaagtggctgatgcccgtaatctctgcactttgggaggctgaggcaagcagatcacttgagatctg

SEQ ID NO: 385797 - DNA, 1187 bp, Homo sapiens
aaatttcatcttccagttgtgtattgctagtctctagagatgcagttggtctttgtgttgtgaccttgtatcctgtgaccttgtaaaaactcatttgttagtctggcagctttttaaatatattttttcagattttccacatatacaatcatatcatctctgaatacagtttttcttcctttcatatttatctgcctctctttttcttgtctcactgcactgactagcatcttcagaatgatgctgaatggttagagtggacatcattgcctggttctggacattagctgtaggtttttcgtagagtaggttgaggaaataaattctcctctgttcctgtttgctgagagtttttgtcatgaatgggtgttgaattttgtcaaatgcttttcctgtgtctgttgagataatcatttggtacttctccttaattttgttaatatagtgaaataaattcacttttcaatgtaaaccaaccttgcattcctaggataaactccagttggggtttctattttttattaaagattttaattcttattaaatatttatatgttcataaggaatatttgtctggagttttatttaatgtttttgtctggttttgtcattagggaatgctggcctcataaaatgaagtgagaagtgttccctcttgttttcttgaggactttgtatatgattgttctttgattaagtctttagttccctagtgaagtcacacagacctgaaattttctttgcaggaaattaattgtgaattctttttcttttctagatatggagctatgcaaattttctaatttttcgtgtgtctgtggttataatttgtgtctttcaagtaatatatccatttcatcttaagtatgttgatataaggttgtttgtattcttttaatatttataagatatgtagagatgtttcattttcattcctgatgtacgtcatttctttttcccacttttccataaccaacttagctagaagtttatcagttgtgttgatcttttcaaaagccagctttagcctgggcaacatggcaaaaattagctggctgtggtgtcacatgcctatattcccagctacataggaggcttaggtgagaggatcacttgaacccgggaggcaggggctgcagtgaaccgagatcatgccactgcactccagcctgggtgacagagtgaaa

SEQ ID NO: 385798 - DNA, 339 bp, Homo sapiens
atctgtattaactttgaaaactgaagtaaatgcaaaattatcttctgtatataaaaacaagccccaaggacaccaaaaaactccctacctccatttgctaactggaatagcaaatattctgccactcttctgtcccaagtccacaggagacactactaatgaattgcaacacacttacttctggctcagaaagttgcctgagcatagcatcccaagcagcagttcaatcacctggagatggcataagatggaaccacctgccctctctttttcacatgtctgtatgcattcatgcacgcatgcattcatcagctggaagctacagcagtgtccagcagt

SEQ ID NO: 385799 - DNA, 498 bp, Homo sapiens
  misc_feature (223)..(223): n is a, c, g, or t
  misc_feature (225)..(225): n is a, c, g, or t
  misc_feature (228)..(228): n is a, c, g, or t
  misc_feature (230)..(230): n is a, c, g, or t
  misc_feature (233)..(233): n is a, c, g, or t
  misc_feature (237)..(237): n is a, c, g, or t
  misc_feature (245)..(245): n is a, c, g, or t
  misc_feature (256)..(256): n is a, c, g, or t
  misc_feature (263)..(263): n is a, c, g, or t
  misc_feature (282)..(282): n is a, c, g, or t
  misc_feature (291)..(291): n is a, c, g, or t
  misc_feature (295)..(295): n is a, c, g, or t
  misc_feature (308)..(308): n is a, c, g, or t
  misc_feature (310)..(310): n is a, c, g, or t
  misc_feature (321)..(321): n is a, c, g, or t
  misc_feature (328)..(328): n is a, c, g, or t
  misc_feature (337)..(337): n is a, c, g, or t
  misc_feature (352)..(352): n is a, c, g, or t
  misc_feature (355)..(355): n is a, c, g, or t
gggagccattgtggctccggccggttgcgcgggccctcggaccctcagggtaggcgagggttcgagggcacgagttcgaggccaacctggtccacatgggtaaaaaaaaaaaaaaaaaaaaaaaaaaaaactgtggtgggcgcgcgcgcgccgcgcggcccctcgagaaaaaagcttttataaaacacacacttgcgcgtgtgggggcgcgcgcggggccccnangangnganaagnggaaacangtgggccaaanacgcggntctcccaagaggagaaacnccgggccanaganaaaaggggcgggngnatttctcaccncaaatanaaaaaacgnccggggggggaaacncgngagagcggtttgtggaaacaaatttcagagagaggggaggttctgggggggccaattatgggggggatcttctacaaagaggggcgttccaaagggagaccgtcatcattcaaaaattacacccggcgtagcgtgggatgaag

SEQ ID NO: 385800 - DNA, 317 bp, Homo sapiens
  misc_feature (243)..(243): n is a, c, g, or t
gggagccattgtggctccggccggttgcgcgggccctcggaccctcagggtaggcgagggttcgagggcacgagttcgaggccaacctggtccacatgggtaaaaaaaaaaaaaaaaaaacggcacgagaacaaccacaagaaagggagaagaggtgcctgtgggagattttgcagacctattgtgggtataggtatttttttcctggggaagaattcagttcccgtctcagctgtacttttntgggcctgtcatcttgatgaccagaatgaaagcttgctctgcctcctgccagccagaatttgtggcgggacttt

SEQ ID NO: 385801 - DNA, 394 bp, Homo sapiens
ccaacagtatgacacacaactttaggggcacatgcagcatatgcttttattgcatgtaagtccttggacttttatatttatttcatgtattttaaatatttcttgaaatcaagagcgttaatattattagtaacaaacatctgtggtcattttcttccatttgtcacatagctaatacagagtatatagtattacttttgagtggccttatgtaacatctcctttctaaattcctgaaagtaagttacgaccagaattacatactaaaaagagtcaaagaatacattacctacttctataaatggataattttatagtaatctaaataaaaatgagaccagaataaatatttttctagccttctctggaatgctaagcagtgttggggagggag

SEQ ID NO: 385802 - DNA, 363 bp, Homo sapiens
gaaatttatgccaaagtcttcccaagacacctcttagtaagaaagctaaaaggtggtttgttgactttctcttaggcaaaaaggacagatttttgggcccaagattttaattagaattgtcttccccagaagaaatttagtaaagtgaacagtaagtgtttccttactctcaccactgtttggtgacactgtttgacttgacagttctagtgctgagtaatagtgtcttctcctatcactgtctgtaaaactgttactgcactattggttgatgatatctctctcttttttttttcttaagagacagagtctctctctgtcacccaggctggagttcagtggcgtaatctcggctcactgtaa

SEQ ID NO: 385803 - DNA, 389 bp, Homo sapiens
gctcctgcatgaaagtcctgggtgacattgaagacacctaaatgatagccggcatccctggcgccactcactaaatgcccttcgactactgacaacagaaatgcctcggtatgtttccaaaatgctcccgggagatgccaccacctctgttgagaagactgacatccgagggtggagaatcactactgcgagaaggaaaacaaaaggtgtgtccttgaatgtgctgccggagcgtccagtgtctcatagggccccacgtgtgggacccaccaaagagaaagtgataggatatctatgagtcgatctcgtcaatgtccccaccttgaaaagtacaatccaatgttggaaccacttcccacccaccttcctcttctttctcctcagctagg

SEQ ID NO: 385804 - DNA, 900 bp, Homo sapiens
atctgatggcagatgcccctttgcttccttaattctgccattcaagcatctggagcctgggtgaggtgggttgaatcaggccagcctttggcataattgaaaggttttctcttctgttttttaaaatcccctctgtgggctaatctttattggatagcatgcactaaattgatgagaaaagaaactcaatcttcctttcaatgaactgacatcctaatatggtccccaagatgcactgtaagaaggaatttgtcttagtcacaaccgttcagactgctgtaacaaaataccttagactaagtaattgataacagaaattgattgctcacagttttggaggctgggaagtccaatatcaaggtgccagcagattcagtgtctggtgagggcttgccatctgcttcaaagatgatgcctttttgctgcatcctcacatggcagaagggaagggcaaaagggcttccttgagccttttctttaaggcactaatcccattcatgaaggtggagtcctcatgatctcacctcttaaggccctatctcttaattctgtagtgtcgggattaggattcaacctgtatattgggggagacagcaacattcacaccatagcagaagtcctccatgctttgggggtttgagattctaggtagattagaaaatacgagcaaggaaataaagtgtttgctagtagaaggcaaaggaggcatccagacccagcagtcttggtctccaggacactgaaccatggctggaaaagaagctctcctcctcccttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 385805 - DNA, 1847 bp, Homo sapiens
accagcccttctgacagagctggaaacaggcaccaagccctccaggaagctatttttagggttcatctgttcttttttatttcttctctggattccatattctctcacccccaaatttaaaggacctaaagatcctggaaatcattcattatacccccagctcgcaagctgtggcttctccccaaccttctctgtaccactccctctttctttcttcctctccgccctcacccctctggttctccagctccacaggcagcagagaaagcaggctctttgtctgacatcatctttcactccctggcctgctaagagttactcactcaggcaatccctgctccaccagaggagactgtccaattgccaagcaacccactgctggccaatcacagagcttggaggtgatgtcatggcaagagcgagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagagggggtgtgagtaccagtggtgttgcttccaccctgcagcaggtgggatgaggtctgtgtgtgtgtgtgaaccatcattttttgatcatcatgaccaatgaaacattgaaaaaaaaaatccagttctttatttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 385806 - DNA, 1928 bp, Homo sapiens
accagcccttctgacagagctggaaacaggcaccaagccctccaggaagctatttttagggttcatctgttcttttttatttcttctctggattccatattctctcacccccaaatttaaaggacctaaagatcctggaaatcattcattatacccccagctcgcaagctgtggcttctccccaaccttctctgtaccactccctctttctttcttcctctccgccctcacccctctggttctccagctccacaggcagcagagaaagcaggctctttgtctgacatcatctttcactccctggcctgctaagagttactcactcaggcaatccctgctccaccagaggagactgtccaattgccaagcaacccactgctggccaatcacagagcttggaggtgatgtcatggcaagagcgagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagagggggtgtgagtaccagtggtgttgcttccaccctgcagcaggtgggatgaggtctgtgtgtgtgtgtgaaccatcattttttgatcatcatgaccaatgaaacattgaaaaaaaaaatccagttctttatttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 385807 - DNA, 1386 bp, Homo sapiens
accagcccttctgacagagctggaaacaggcaccaagccctccaggaagctatttttagggttcatctgttcttttttatttcttctctggattccatattctctcacccccaaatttaaaggacctaaagatcctggaaatcattcattatacccccagctcgcaagctgtggcttctccccaaccttctctgtaccactccctctttctttcttcctctccgccctcacccctctggttctccagctccacaggcagcagagaaagcaggctctttgtctgacatcatctttcactccctggcctgctaagagttactcactcaggcaatccctgctccaccagaggagactgtccaattgccaagcaacccactgctggccaatcacagagcttggaggtgatgtcatggcaagagcgagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaagcggctgcagggcgcaccagagaacccagccagagggggtgtgagtaccagtggtgttgcttccaccctgcagcaggtgggatgaggtctgtgtgtgtgtgtgaaccatcattttttgatcatcatgaccaatgaaacattgaaaaaaaaaatccagttctttatttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 385808 - DNA, 282 bp, Homo sapiens
tatacggctgttagaagacgacagaagggggtgtgagtaccagtggtgttgcttccaccctgcagcaggtgggatgaggtctgtgtgtgtgtgtgaaccatcattttttgatcatcatgaccaatgaaacattgaaaaaaaaaatccagttctttatttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 385809 - DNA, 1901 bp, Homo sapiens
accagcccttctgacagagctggaaacaggcaccaagccctccaggaagctatttttagggttcatctgttcttttttatttcttctctggattccatattctctcacccccaaatttaaaggacctaaagatcctggaaatcattcattatacccccagctcgcaagctgtggcttctccccaaccttctctgtaccactccctctttctttcttcctctccgccctcacccctctggttctccagctccacaggcagcagagaaagcaggctctttgtctgacatcatctttcactccctggcctgctaagagttactcactcaggcaatccctgctccaccagaggagactgtccaattgccaagcaacccactgctggccaatcacagagcttggaggtgatgtcatggcaagagcgagcagtggtgctgatgttgagagaagcccagggtaccactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggaaccgcctgctgcgcggtgactcccgggacctgatcggtggcctcgtcccatggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagagggggtgtgagtaccagtggtgttgcttccaccctgcagcaggtgggatgaggtctgtgtgtgtgtgtgaaccatcattttttgatcatcatgaccaatgaaacattgaaaaaaaaaatccagttctttatttcccctgcaaacatgagtgcaggggctgcctgtgttaaccgggtcccaggacctcttcccactctgctctgcacactgtgtagttttttacagctttgcaaataaaccctttggtatagccttt

SEQ ID NO: 385810 - DNA, 472 bp, Homo sapiens
  misc_feature (2)..(2): n is a, c, g, or t
  misc_feature (52)..(52): n is a, c, g, or t
  misc_feature (115)..(115): n is a, c, g, or t
cntctgccaccctttccactacactatgatcctgactagaatgctgtgtgtnaagatggtggtcatgtgccatgctctctcccaccttcatgccatgctgcatacctttctcatnggccaactaatcttctgtgcagataacagaatcccccacttcttctgtgacctctacgctctgatgaagatctcctgcaccagcacctacctcaacacccttatgattcacacagaaggtgctgttgtaatcagtggagctctggccttcattactgcctcctatgcctgcatcatcctggtggtcctccggatcccctcagccaagggcaggtggaaaaccttttctacctgcggctcccacctcactgtggtggccatattctatggcaccctcagttgggtctacttccggcccctttccagctattcagtgaccaagggtcgcattataacagtcgtgtacacagtggtgact

SEQ ID NO: 385811 - DNA, 678 bp, Homo sapiens
atatccccctgtctcaccaaccaccgtgcccagttaattacaaaaaaaatttgcagagacggatggggtttcaccatgttggccaggctgggtcttgaactcctgacctcaagtggtccgcttgcctcggcttcccaaagtgctgagattacaggtgtgagccaccacacccagccaggacatgtgcacttttaatgatcacctaaacaggtcaggattctgaatacaatactgccaaatatgaaaactctccccttacactttcacatccatataataaaagccctgccctttcataaaaaagacagtgtggtgctggaggagggacagacacacattttagcgtcagacaaacctggtttctgccactttcataaactctgtgatcttgggcaacattctgaatttccaccaagcttcagcttctgaagcagtaaaaaagggataataaaactcacttttggtcttcctgtaagaattaacttatgtacatatatagccattagcacatgatgctcatacaactggtatttattttcctgctgttcctttttgcatatgtaaatttaggcaaaaattttaaactttcacttgtatatacacacgcatactttggacactgaaatcttcagtgtatttggtgcttacatttaaataaaatgtcacattttataaatt

SEQ ID NO: 385812 - DNA, 1089 bp, Homo sapiens
cagcctcgccgcccccgcgtcgctcgctctcgcgaccctgtgaacactttgaaaaacaagagtcgggggaagcaacgggctaagcgctgctatttggggcactaaaaggaagccggccagaggtggcgggttcatgcgtcccccgagacccaggccgcgtcgggggccaagagcccttacagccttctcccgcgccgtcgggaggtcctcccggaactgggccggagcgcagagaacgcagtgtgagaagggcccatgggttttaggtcacctccttcgcgctggacgcgggcagagcggtgtccctttctgtctctgccaagagacgtggagggagggagaagggaggatggcttgtgctgaaagaaacaagaatgaagtcgggcagccgggatctgagaaatgggaaatccatggcccttgttcgggaccacaggctttgccgacgtggtctctcctagttccgaaattgcccaggcccgcctccccactctctgcaagcagcgggaacgacttccacatcgcttaatttctttattaaacttttcacctattctcttctaaaggacagactacagcgtcagatggtaaaaatgttttccgcgccttgtcttgccgtacggaaaccgccggcctgggaggacaagccgagttcttgttttgccgagagcaaaactctaggctcccacttccttctcccagtccgtgcgtttccttgcagagccccagagcgtctgattcactgaaatagcatcacttgctgaaccaaaccttttttcccgctcgcggaaagagtggagcttttttcttttgtctaagggtgtttgcttttttttttttctttcactcggcaccacagtttttctaaatcactgggaatgtgagtcaccgctaacagcaggagacctttggcggcacccggctgtggggcgcgctcgcagcggggagcccaccctgattgtctaggggatccggcactgaagttgggagaggttgcagtcaggccaggctgggtttcagggaaagggcacagggatccagcgcaccaggcgaccgtctggatctctttcctagcagccagccgcgcac

SEQ ID NO: 385813 - DNA, 151 bp, Homo sapiens
agagcttaaaaatagtgaagtctttataagtaatttttaaaaatttaaactaggaccataaatttctaaactatgagataaatgaacaagaaaacaaacaggtgtttaggaaaaggtatgtatatggtcaatgaaataaatacaactgtat

SEQ ID NO: 385814 - DNA, 687 bp, Homo sapiens
tggctggaaattcagcccatattgaggcccttctcattcctgcaggtgttaccagcaactcagaggtttatggagtaacgaaattggggagggcctcacatccggctgctgtttttccccctaacgtgtatggtgcttattctgagccagacacttttaagaactgcacattattaaccattttaaatcgtccccaccacctgatgaaataggtactgttatccccactttatgggtggggaaaccgaggcccagggaggtcaagtaactgcgcaaagcacaaaactgttgagtagtagtgttaccagggcagtcctggagaaatcgctcagagggcaaaactgagagctcattattttcttaaacagtagacagctgaaaatgctcattgttttttaaaccgttttgtttgtttgattttttttcctagtctctttatctataggtaacccagcttaaaacaactgcggttggcccgggatcctcactgccctttgccaagtaccagagaaagataaggcctactaggaaccagagaaaaccagaaccagccaccccttgttacttttagatcattaatacatcattatatgctcaactcccgacccgtagaagagaatcgccgccattttctgatagtgcattgtatgaagaggcatgtttatgaaatgcacctgtgcgtctaga

SEQ ID NO: 385815 - DNA, 181 bp, Homo sapiens
ggcaggcaggtaccagaggactgaggaggccatcatagagggcagaagggcagagggagccttggggcagctgtgacaggcaaggcaccttctgtcccccaccacggggcctgggcagaaaggcaagaagaggagcgcagatggacagatagacagacggtgttgagagaagatgggaggg

SEQ ID NO: 385816 - DNA, 461 bp, Homo sapiens
cgcttcccgggttcaaacgattctcctgcctcagcctcccgagtaattgggattacaggcacacaccaccatgcctggctaatttttgcatttttaatagagatggggtttcaccatattggccaggctgttctcaaactcctgacctcaggtgattcacctgtctctgcctcccaaagtgctgggattacaggcatgagtcactgcacctggccaaattcgtcttttttaaagcatacacttctgtggtttttagcgtattcacattgctgtacaaccatcacgactataaaatttttctagaacatttttgtcaccctgtaaagaaactccgtattcattaccatttattcttcatgtctcctcccctaacctctggctgctaccaatgtgcttatccatctctatgaatttgcctattctggacatctcatatgaatggaatcatataatatgtagcc

SEQ ID NO: 385817 - DNA, 203 bp, Homo sapiens
gagatccatcatttttcttctagtaaaataagaagaaaattatgtaagccagagaaaaatagagctcaaagttgaaatatgactgtgactaatgttaatgtgctgctctttctttctaaaattatagaaacatggacaatacttagaaacaactggtaatattctttgccctttgaaaatttccatctgaagaggtggaaatt

SEQ ID NO: 385818 - DNA, 1966 bp, Homo sapiens
ttgatgatcttgaagtcacaagaaaaaagctggttgatgattgccatcattttagactggaagagcctaatttctccctggcaagtagtaactctaaagatatcgagagctgtgcccaaatttgggccttttatgaagagtttcaacaaggatttcaggaaatggccaatgaagactggatcacttttcggactaagacatacctgtttgaggaatttttgatgaactggcatgtcagattaaggaaggttgaagaacattcagtgatgacagtgaaattacaatcagaggttgacaaatataaaatcgtaattcctatcttgaaatatgtgagaggggagcatctttctccagatcactggcttgacctttttcgtctccttggacttcctagggggactagtctagagaaactactgtttggtgatttgctcagagtagctgatacaattgtagccaaagctgccgaccttaaagatttaaatagtcgggcacaaggtgaagttacaatcagagaagctttacgtgaacttgatctttggggagttggagcagtgtttacattaattgattatgaagacagccaaagtcgaactatgaagctgattaaagactggaaagatatagtaaatcaggttggagataatagatgccttctccaatccttaaaggattctccttattataaaggatttgaagataaagtatcaatttgggaaagaaaacttgcagagttagatgaatacctgcagaatttaaatcatattcagagaaagtgggtgtatttggaacccattttcggccgtggagcattgccaaaagaacagacacgcttcaacagagttgatgaagattttagatcaataatgactgatatcaagaaagacaatagagtcacaacattaactactcatgctggaataagaaattctctactaacaatacttgatcagcttcaaagatgtcagagatcattaaatgaatttttggaggaaaaacgctcagcattcccaagattttattttattggtgatgatgacttattagaaatattgggccagtctaccaacccatcagtgattcagtctcacctgaagaagctttttgctggtattaacagtgtttgctttgatgagaaatcaaaacatataactgcaatgaaatctttagagggagaagttgtaccttttaaaaataaagttcctctatcaaataatgtagagacatggttgaatgatttggccttagaaatgaagaaaactttggaacagttgttgaaggaatgtgttactactgggcgaagttctcaaggtgcagttgacccatctctgttcccttcacagattttatgcttggcggagcagattaaattcactgaagatgtagaaaatgctattaaagatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcagggtaatgcttccaaactggtttatactccactgacagacaagtgctacttaactctcactcaagccatgaagatgggacttggaggaaatccttatggaccagctggaactgggaaaacggaatcagtaaaggctttaggtggacttcttggaagacaagttttagtctttaattgtgatgagggcatcgatgtgaagtcaatgggacgaatatttgttggtttggtgaagtgtggggcctggggttgcttcgacgaattcaaccg

SEQ ID NO: 385819 - DNA, 384 bp, Homo sapiens
atattccccattacttcagcattgcaaatttgagtattacatttcagcttttaggctgcatgtgagaccatgtccagatgttcatccagacccacagcatggcagaggccttgttgttcactggcagtctccatcagaccttccgtcccaggatgttctttggaggatcttcaaaggcaaccttcctgtggctgcttctccgtgtttgcagtttgaaaatggactagaaccactagcacaagacagcggttatcttgaatgtccatagcaaagatattagtatcttaaatgtttaaattattatcctttacaatgttgccttttctaagtttgtattatttatacttctaacaccattacagtttaaacctgcagtaagacctt

SEQ ID NO: 385820 - DNA, 2864 bp, Homo sapiens
caaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccaaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggttttcccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtcattttaagaa

SEQ ID NO: 385821 - DNA, 1514 bp, Homo sapiens
caaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgtaagtgtattttttcctactaatagagctttgttaggtatatgcagctggtacaaaatgtccatctacagattcatgtgtatgaggaatgcaacttcattctttggtaacacaaagttaatttctatttggaggccccattttgcaagattaaagaaacttaatctcagctatggagttttctgtccactgtccccagggttatgtctatgttccaaatgagggtttgggccaggcatggtggctcatgcctgtaatcccagcatgttgggaggctgagacaggtggatcccctgaggtcgggagttcaagaccagcctgaccaacatggtgaaaccctgtctctactgaaaatacaaagattagctaagcgtggtggt

SEQ ID NO: 385822 - DNA, 2311 bp, Homo sapiens
caaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcagg

SEQ ID NO: 385823 - DNA, 1735 bp, Homo sapiens
caaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggcttttaggctgcatgtgagaccatgtccagatgttcatccagacccacagcatggcagaggccttgttgttcactggcagtctccatcagaccttccgtcccaggatgttctttggaggatcttcaaaggcaaccttcctgtggctgcttctccgtgtttgcagtttgaaaatggactagaaccactagcacaagacagcggttatcttgaatgtccatagcaaagatattagtatcttaaatgtttaaattattatcctttacaatgttgccttttctaagtttgtattatttatacttctaacaccattacagtttaaacctgcagtaagacctt

SEQ ID NO: 385824 - DNA, 236 bp, Homo sapiens
gtatgacgtactcttcatgtctctatctctttctgtttttctctgatcttagttatttcttgtattctgatagcatttgaatttgggtgctccatcccccacctccagccggacctccagccaggcttccctggcccctcacccccttgggtcgccagggaccacctcgttcttcatggtggctaaaccaggcccatgggcgcccaccctgccccagggggaagctctggcgggcg

SEQ ID NO: 385825 - DNA, 350 bp, Homo sapiens
aatggctgagatagagaggtccagaatgctgaaaggtgggaagttagccaaaaaggttgctgatgaaataaggatttaatagacatctgaaggaaatcgggaagggaggaagaaggcaggaggaagagcgttaagacctcagagcaggaagcttgacaaggatgagtaaagtggtatctcagaaaaatacttggtctttgtccctccttgatcactgagacagagctcttaagccccttggaatttcctgggtgacaggggcaacaccttttgttctaagggggccacttttttttttttttttttgagacaagagtttcacttttgtcacccaggctggagcacaatgg

SEQ ID NO: 385826 - DNA, 871 bp, Homo sapiens
caacaacggaacccaggggacaggactgcatcaactacaaccagacggcgtagacggggcacacggccctcggcaaatcagaggtgctcagtgaccacagccaccatgacagcagggcggggcggggggcaaggaagcagcgctgggagacttggagacaccccaaaaaacgccttcctcagaaacactgctgtgcaagaacctgcaaatccctaaggcgtctgtgtccgatggccccggccccatgctctgaggtcgcgcaggtgtccaaggccaggaggggcaccgaggagacgaagaagaaacagcacagcagctggggaggtaggaacagcagagtctgagtcaccaaagcccggggctgccactctccagggcgccccactcccagctccagcggctgagtccaccaagccaggacaggcccaaggaccagagggcgaggtgattcacagtggagctcggaaagacccatccatgcccagcgccttgtcaaaaaccacaggggtcttggtgacaagcaattgagggaggccaacatggcagagccagggctgcaaaatcggctggaataagcatcagacctgctagaagggttttctgtgcctgttttcggtgagcacagaacaactgaaggaagcgcgggacagacacaagggcgggcctcggtgccacggctggccttgggcagagggaaatgctttgtgtactttctctgggaagcagcatgccccagcgcggcctcggcgtcctctgccgccaactgctccgtgaccgctgggcgtgtgtgcggggacatgggagcaacttcacagtggtgggaagtttctctcctaaaacgaaagcttctctatactacagattggcccca

SEQ ID NO: 385827 - DNA, 577 bp, Homo sapiens
ctatgcatataatccacaaacatttacccctatcaatatgtaagctatttcgtattgataggaccagctcggaaaaaaggataccaggagcctttacagatgttattctcaacttactttctttttttttctttttgtttttcttttctttttttttttttttttttgagacaaagtctcactcttgtcccccaggctggagtgccatggtgcgatcaagggtcactgcaacctttgcctcccaggttgaagcatttctcctgcctcagcctccctagtagctgggattacaggcacccgccaccactcccagctaatttttgtatttttagtagagacggggtttcaccatgttggccatgctggttttgaacccttgacctcaggtgatctgcccacctcggcctcccaaagtgctgggattacaggcatgagccaccatgcccagccgttaactcaactttctatgcacagatccaaaagaccaaaagacttgaaaaagaataaaaggcacttttaagtactaaatgctttctacttgcaagactaactgctttacaagcatgattcatttaat

SEQ ID NO: 385828 - DNA, 336 bp, Homo sapiens
tcggctcactacaacctccacctcctgggttcaagtgattctcctgcctcagcttcccgagtagctgggattacaggcgtgtgccaccacgcctgcctaattttatattttattagagatgaggtttctccatgttagtcaagctggtctcaaactcctgatctcagctgatccactctccttggcctcccaatgtgctgggaatacacgcgtgagccaccgtgctcagcccaaaatcttttattaccagactagccaggacagccaatatttctggcttttgaattctaccacaggtaacctcccatgtgaaattaatacattttaactaaggtc

SEQ ID NO: 385829 - DNA, 514 bp, Homo sapiens
aactgctgcggtcacctctagacggatcccggagtgacgagacgcgcttgctactcgtgctcatagaccggtctaaccttggcctcccaaagtgctgggattacaggcgtgagccaccgtgcctggcctgtccctgggtacttgagattagggagtggtggtgactcttaacgagcatgctgccttcaagcatctgtttaacaaagcacatcttgcacagcccttaatccatttaaccctgagttgacacagcacatgtttcagagagcacggggttgggggtaaggttacagattaacagcatctcaaggcagaagaatttttcttagtacaaaacaaaatggagtctcctatgtctacttctttctacacagacacagcaacaatctgatctctctttcttttccccacactggactaacacactgctaatctcccaacaattcactaaacttgatgcaaatcaatcccaaataactaagtttctgccagcttttttttttaaattttttta

SEQ ID NO: 385830 - DNA, 4327 bp, Homo sapiens
ctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385831 - DNA, 4528 bp, Homo sapiens
caagtgtgagccaccgtgcccagcgaccctgaatttctgtgtagggggagaactctcggttacctctctgagaattggccaaattctggttctgcaagatatgagactttgaaagatgctttgctgttctgatctctacttacctcatttataaaatgtaaatgatgatagtgcctgcttctacagcaatagtgaggattcattgagatggcctgtcatctggcagaaggcctggcccactataagcacttactgaacattagcagtgcttgttaatgtgaagactgaagctgggtctcgaatgaaggctacagatgacaatctagtcatttccccaccccaccccaggccctcaaaaggggaatctggaagggctgtttgccttggcactgatgagctccctctccctctttgctctccttcccattctctctctctaggggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385832 - DNA, 4215 bp, Homo sapiens
ctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385833 - DNA, 3599 bp, Homo sapiens
ctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagataaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385834 - DNA, 1367 bp, Homo sapiens
tttccttttaaatataaggcaacttgccaacacataacttaaaactggtctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385835 - DNA, 1257 bp, Homo sapiens
tgcggccgccccaacatcagaatggtgcaaaaatttgtaacaaaacagtctaagtttaaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385836 - DNA, 4361 bp, Homo sapiens
ctccgggtagtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385837 - DNA, 4409 bp, Homo sapiens
ctccgggtagtccccacagctgcgccggtgactgaggggccgggcagtggagaagtggtggcggcgggcggcgggcggcaaaggagcagccatgagggccgggcccagtcaccgaccgtgctgaggagtcatggaagagtttttaaaccaggaatatcacaggagtgatgctgtgttcttcactgcatgatttcaaaagtgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385838 - DNA, 4218 bp, Homo sapiens
ccctctcttccatcctcccggggcgggggtgagctgggctcagctgcccaaggcgggcggggcggagccaggagccccacggagcgctgcggagcgaacctcacctttccagggcgcaagtgtgagccactgccccatgttgtgttgatgccaatctgccatgctagcctgtctaccagggccaggtgacctgtcctttcagcttctttctcacacgcagatgaacactggacttcagaaattgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactactgttcgttagccagaaattctctagtgatctgaagcaatgtgactgaagaccagttttaagttatgtgttggcaagttgccttatatttaaaaggaaaaagaaaaaaaaaaaagcctgattgtgttatgccaaatgatagcaacatgaagtcctaatttattgttcccaattgttttcctgccgtctgtgaacactggtacctccctgtcctgatcccccaggagcacctgtagcttctgactcaatgccttctccgaaggtgttggccgccatctcacccagggccctcttccagttcctgcttttctgagtcagatttaaagagcaccactgtcttccccctaccccttgcttgatctccaaagcagatattcttgctgtatttttttttcctccccaatacctctccctgaaaggtgagctgctattttaggaaactggaccagacaccaacttgggggctttaagtcaaacaacctcaaacccatctcttcctgtgtaggggtgcaagcctctgaagctctcactcccacccttagtctgcatggaaaatgtactgtgatccccctgcccccaactgccctcgcctttggtgtgagatgttccttctttcggagttcagcctgagtccctctcccctctgccagccaacccccagccagcaataagggtccaagccagggcctcctctccacactccctgtctccatcctacactaccctagggaatacctggattccccattctatccacatactgtagcattcattctccatctctctcacctcacctgtggtggtttatgggtgtgatggggtttttaagattattataaaccagtaaaaataagaaaacctcaaaaaaaaaaaaaaaatctaaaaaaaacctggcggccggccttggccagtcactttagactcgagcaggcttatgatgccggccgaattgagctaattggcccaatcgccctaagggaggcggttaaaataactgcccgcgtttaaaaacgcgggactggaaaccccggggtcccaactaatagcttgtag

SEQ ID NO: 385839 - DNA, 3205 bp, Homo sapiens
ctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctccgcgggtagtgaaaatgttggtgtatgggtagtcatggatgtatgtgtcacatctgaatgtgataagcagtccagcatcacttaggaaatgttacatgcggaatgtgcacggttccaggggcgagtaccgtcaatctaaaggttcgcaatggtttccttcctgccaaacatatacatgtggccctgcccaata

SEQ ID NO: 385840 - DNA, 2291 bp, Homo sapiens
ctccgggtagtccccacagctgcgccggtgactgaggggccgggcagtggagaagtggtggcggcgggcggcgggcggcaaaggagcagccatgagggccgggcccagtcaccgacctgtgagccactgccccatgttgtgttgatgccaatctgccatgctagcctgtctaccagggccaggtgacctgtcctttcagcttctttctcacacgcagatgaacactggacttcagaaatgggacactacacagaaaatgagaactgctcactatcctaccccagccgaattggatgcgtatgctaagaaggtcgcaaacaacccactgactataaaaatcttccccaacagtgtgaaggttccccagcggaaacacgttcgtcgtactgtgaacggcctcgacacatcagcccagcgctacagcccctacccgacacaggctgccaccaaggcaggcctgcttgccattgtcaaagtgccagccaaaagcatactcaaggactttgacggcacccgagcccggttgctccctgaggccatcatgaaccccccagtggcaccctatgctactgtggcacccagcactttagcccacccccaggcccaggctctggcccgccagcaggccctgcagcatgcacagaccctggcccatgcccctccccagacgctgcagcaccctcagggtatcccgccaccccaggcactgtcccaccctcagagcctccagcagcctcagggcctgggccaccctcagcccatggcccaaacccagggcttggtccaccctcaggccctggctcaccagggtctccagcacccccacaatcccttgctgcatggaggccggaagatgccagactcagatgcccccccgaatgtgaccgtgtctacctcaactatccccctttcaatggcggccactctgcagcacagccagcctccggacctgagtagcatcgtgcaccagatcaaccagttttgccagacgagggcaggcatcagcactacctcagtgtgtgagggccagatcgccaaccccagccccattagtcgcagtctgctcatcaatgcaagcacccgggtgtcgacccacagcgtccccacaccaatgccttcatgtgtggtcaatcccatggagcacacccacgcggccaccgccgcgttgcctgctgcaggtcctgtcaacctgcccacaggcatctctcgcgtccccactggctaccctagcgacctcaagccagtcacctggaaccagcaccagctggcccacctacagcagatgtgcagcgaggctagtgggacgccagcccctggcctgacaggcaagcatgcggcaggacgcgagttggcagggcctggctttgtgggcaaggcccctgcctacccgcaggaactctgcctggcgcagtccttccatctgaagccacccctggaaaagccgaccccatccccaccagtcaacggcatggcagccccattggcctaccccaatggtcactacttccaacccctgtggaacaacattctgcccactcccaatagcgacagctcggggtctcaggaccttgccatgccgttccacggtgggcagcccacaggtgcacccctcgactgtgcggcagctcccggggcccactaccgagcagggaccgggggcggtccagtggcaagccagaacagcttgatgcaaacagtggattacctaagtggggatttccaacaggcctgcttccgagaacagagcctggccatgctgagcaaggcccaccgagcccctggcaaccgagcccccgatcccacagagagtcgaagtcttcatattcagcacccagggtatagataggtagccctgctgccctccacgtgcaacacatcatacatcaccctcctaggtttagtcttttaagtaactggatagtttcaaagtttcactgctccagtgtgatcattcttagatgtctaagaaagggaatttggtgggatctaagtggggacagaaggggtcctctcgtcctcccctccagcaacttttggttttatgttagaacctaaccctaagcccaggcttttctctccactgactgcctgtcagctagtctctccaccttggccatttccagccagctcccacccatcttttcttgaatctcttcctgtttcccttaggacgactgaggtgtgggctgacggaatgccctagttgaggtagtataggtgctcaggcccctaatccagacctctacctgttgccgtgtgcctccggggatcctcgagaacgccaaccgacg

SEQ ID NO: 385841 - DNA, 836 bp, Homo sapiens
tagtgggagaagaggaggagagtgagcttttattttcttcaccttaactggaagcctggttgagatgagaagcttcttaccttaacaatacccagttgacaggagaaaagaaggcagctcaacctggctaagcaacgcgctcaaagtccctgtggtgatgatgggctgggattccatgccacctctatccagtgtgaaaacccagtcctttaaaatgcattgtgcttttttactgcttaatgtttacggaagtgtgttttgcctacatctagaatcaaattaaaatcaaattagaagggatgcttacaattttgggaggattaatgttttgaagataacatatctgtcttacctctaagttttatggggaaaggcaacattcatctcataagtttgcagggtttttattcagaaaaacatctttgtatatcttgattgaaaaagacatgaacttttgggcacagtctaggttgagtaagtcactgtgatgagctgaactgcactcccctccaccaatttatgtattgaagccctaattccccagtactttagagtgtgaatatatttggagacaaggtctttaaagagataattaaggtaaaatgaggttgttagggtggaccctcatccaatacgactggtatccttgttaagaggagatgaggacacagacatgtacagaggaaagaccatgtgaaaacgcagggagaagacaccatctgcaagccaggatgaggggtctcagaagaaatcaaccctgccaacacctgagctcacacttccagcctccagaactgtgagacaataaatttctgttgttttactcagtctgtggt

SEQ ID NO: 385842 - DNA, 314 bp, Homo sapiens
ctgaggcaaacatagggaactgcctggagaccacgtgatggctttgctccagatagggagcacatgccaagtcccacacaaggcaccattttgaaagcccagctcccacaagactgcatcctgccatgacacccagcagcccctgcatctccacatctctggagccccattgacttcccccagactcagctgaggttgctgtggtctgctgccaccagggctgaagtgtgagccattggcagcaaagcaaccccactgccagtagtagcaggatcactgcacaattaaaagttcccctaggaaaagctaccctg

SEQ ID NO: 385843 - DNA, 138 bp, Homo sapiens
ctccagaggcaacaaatctacaatcaaggctctgattgattcagtttccagtgaggcctctcttcctgacttgtggacagccaccttctcgctgtgtcctttcatgatctttcctcagtgtatgtgctcagagagaga

SEQ ID NO: 385844 - DNA, 320 bp, Homo sapiens
cagttcccagtgagtatcagtccagggcttttggttcccgtcctgactttctacttaactaaagggtgacccaccgaacctcagtttctgccattatgaaatggatctactaatatgtccaataaaatgcaagatactccagcatttcaaaagacaaggcagcaacactgatttaaatattttaaaaagcgacttaaatcctttaattcagcaatcctactcccgagtttagaaaactccattaactaaagttcacaaactcaattcaataaggttaacaatctataagaactgtgtacaaggataattgttgcggtatt

SEQ ID NO: 385845 - DNA, 107 bp, Homo sapiens
tgtttgtgtgaaggggacggtgggaggcctcagagcctaacctgctcagagggtgtcaggggggaaaaatgtggttagaggtcaacccaggggaagggggagaagat

SEQ ID NO: 385846 - DNA, 1878 bp, Homo sapiens
ctgaaaaaacacagatggctaaaagggaacctgaggttatgatgctttaaataaacaaaaaaacttaagacaattgcattccagagttgccttttgcctccaaattctcacaagtttgtaagggagcagtcttttgcaccagacagtttctgggaaactcatcgaatacatgggtgggaggatgagtcgaagtggtctgcccagtgccccctgaagagccctcccctctgctgctatggagctgttcttcaccaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtgataaaagatagagtatccttatggttgagtttccatataagtggaccagacacagaaacaaacagaatgagctagtaagcgatgctgcaacttgttatcttaacaagaattcaagtcgttttaattaaatcccacgtgtgttaaaaagtactttgatccatttaggaaattcctaggtctagtgagaattatttttcaattttattttagttctaaattatgtttcagaaacaaaagacaatgctgtacagttttattcctcttcagacatgaaagggaacatatatattccatatatatgttcaactcttcatagattgtgaactggcccatcaatatggtcaggaatatttgcagtctacattttaaagccaatttatttagaaaaaaaatttgagctttaattctttaattttaagagaagtaatattgtgaactatgtattttaaaatatgatcatggacacacaatgatgaattttttggccatttacatagacatatctattaagtggaaagaaggctttctgaagtctgtttgcacaggtggcatttgcttccaattgtagctagcgcacagagctttggaagcctgtcattatgagatacagtcggtttacctcaggagtcaattcagtgttgtactggtgacctgggatgcagtagtaggcactgttgattcaaatttatcctgtgaaactggctttatagagttaacaaaacagagtcagagaccactgtcttaacagtggaagatgcaaataagtttttgagaataaaactggattttgaaattttacattagtacttgacaaaagttttcattttgccttgaatggaacctactaaaaagagagatgaaaaaaaatcagcgaggttgatgtagataataatttctatgggaccaaagactagacagaattcagtaagtcacatgaagtaatggtcatgcctgtacataaagcatatttcatgtttgatttagatgacattcaaaaaaaatcatgggactgaatatacctggggtatcctatcttgtacaaatgcatgctttttcattaaatttgtaatgatgtttaatgaacatttccaccaaacattatttcctctaaaaatgttaatttggggttaaaaccatcaccatttgaatttcaaatgtagttttcatgacaattttatattgatgtgtgtttacaatgagaaaatggcatgaaaatattaaattgtcttgtatcggaaaa

SEQ ID NO: 385847 - DNA, 3061 bp, Homo sapiens
  misc_feature (817)..(817): n is a, c, g, or t
atcccgctagaatccgtccagtctctgctcgcgcaccgtgacttctaaggggcgcggatttcagccgagctgttttcgcctctcagttgcagcagagaagcccctggcacccgactctatccaccaccaggaagcctcccaaaagagctctcgccctgtggacgactcggaatccctggaaaagccgggagggagtcggaggcgccagcccactggggaggtggcgctgggcgcgcgggatgcgcggggagccttctctgcaggagccgcacagtgcactgctgcgcgctgggcagtgcggggaagcgccgcgggaaggagcggctccgagcaacaggtgcagcacgcagccgctccgggagccagggaaaaccgccggcgaagatctggagcggtaaggcggagagaagggtctttccacctgcgcggctgcagccggcggatccctcttcccaggctccgtggtcgcgcagcgggcggaggcgcccgggcaggggaccccagtgctctcgagatcaccgtcccttcccgagaaggtccagctccgggctcccgaacccaccctctctcagaaggtcgcggcgcaaagacggtgccaccaggcacggccaccggatccccgctcccgctggctcgcgcctcgggggaagctcagactcctaaactcgcactctccgtgctttgcgccgggacccctggccacccccggcgcctgctatcccgccctccctccccgcgcgccccgccgctcgccgggacagccccgcgggccatggagctggcggtcgggaacctcagcgagggcaacgcgagctgnccggagccccccgccccggagcccgggccgctgttcggcatcggcgtggagaacttcgtcacgctggtggtgttcggcctgatcttcgcgctgggcgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtccttaatcacttgcataaaaagttgaagaacatgtcaaagaagtctgaagcatccaagaaaaagactgcacagacagttctggtggtggttgtggtgtttggaatctcctggctgccgcaccacatcatccatctctgggctgagtttggagttttcccgctgacgccggcttccttcctcttcagaatcaccgcccactgcctggcgtacagcaattcctccgtgaatcctatcatttatgcatttctctctgaaaatttcaggaaggcctataaacaagtgttcaagtgtcacattcgcaaagattcacacctgagtgatactaaagaaaataaaagtcgaatagacaccccaccatcaaccaattgtactcatgtgtgataaaagatagagtatccttatggttgagtttccatataagtggaccagacacagaaacaaacagaatgagctagtaagcgatgctgcaacttgttatcttaacaagaattcaagtcgttttaattaaatcccacgtgtgttaaaaagtactttgatccatttaggaaattcctaggtctagtgagaattatttttcaattttattttagttctaaattatgtttcagaaacaaaagacaatgctgtacagttttattcctcttcagacatgaaagggaacatatatattccatatatatgttcaactcttcatagattgtgaactggcccatcaatatggtcaggaatatttgcagtctacattttaaagccaatttatttagaaaaaaaatttgagctttaattctttaattttaagagaagtaatattgtgaactatgtattttaaaatatgatcatggacacacaatgatgaattttttggccatttacatagacatatctattaagtggaaagaaggctttctgaagtctgtttgcacaggtggcatttgcttccaattgtagctagcgcacagagctttggaagcctgtcattatgagatacagtcggtttacctcaggagtcaattcagtgttgtactggtgacctgggatgcagtagtaggcactgttgattcaaatttatcctgtgaaactggctttatagagttaacaaaacagagtcagagaccactgtcttaacagtggaagatgcaaataagtttttgagaataaaactggattttgaaattttacattagtacttgacaaaagttttcattttgccttgaatggaacctactaaaaagagagatgaaaaaaaatcagcgaggttgatgtagataataatttctatgggaccaaagactagacagaattcagtaagtcacatgaagtaatggtcatgcctgtacataaagcatatttcatgtttgatttagatgacattcaaaaaaaatcatgggactgaatatacctggggtatcctatcttgtacaaatgcatgctttttcattaaatttgtaatgatgtttaatgaacatttccaccaaacattatttcctctaaaaatgttaatttggggttaaaaccatcaccatttgaatttcaaatgtagttttcatgacaattttatattgatgtgtgtttacaatgagaaaatggcatgaaaatattaaattgtcttgtatcggaaaa

SEQ ID NO: 385848 - DNA, 368 bp, Homo sapiens
tattggcaattccatttcaatatgacttttgaaggggacattcaaaccattgcacacatcatcatttctctgaagtcaaaaattcccactcagatatctctgaaaaaaaaaatttatttcagaaaacataccaagtaaaatatttattattaccacacttatgtcccagaaacatgccaggttaactccttttgctgatatcctcctaaatctgcctgacagtataaacctgagcatcttttcttaaaagtgtatttcctaataaaactcattagaagaaaacaagttctctgcctactttaaaattaagtcatgctggaagcggtggctcacgcctgtaatcccagcactttgggaggccgaggcgg

SEQ ID NO: 385849 - DNA, 367 bp, Homo sapiens
ggcctcctcaatggctgtcctgggacagggaggctggttagcacaattaacacaacctggtcatgcaaggcattgatggtccgtaacatgaactttgaccagtaggagacagagaatggaaaaaagccagcagataaatcatctggccttcctcccctatgacagactgttctgagccacagtgtttcacatgtcttcctggagatgtcccacatgacttgagcaaccagctggagctctggagaaactgtggccatcctggtaacatatgaccttgtatttgctttctctccttcctgctttatttccctatgtcccttactttggttgttgggattgcacctcccaataaagcattagcatgtcc

SEQ ID NO: 385850 - DNA, 495 bp, Homo sapiens
ttgtaggggaggccaaagttctctggaaaaccagtaaggtccttaggactggcctctgaaaacctctgcagcctgtcaaggactctgttacttggctttctactctgtgtggctccatcatggtagcctcattggttccccaagtcagccatacttcttcctcctacagagcatcttgcacaagtcattccctccactggggctgctggtgaggtttcctctctgcctagttaaggtatcttcctatcacctctcaactgaatcaccttttccctcagggctgcgttcactccccataaagcataacttcatagcactatgctcctttcttttgaagcacttgccccagttttaaaaacatagctccatgattctttaatggaaacactcaccttgacagtgttttaagctatacattccagaagggcaaagatcacaccttttaaaaagtcaatcattttatctctagcgcctgccctgacactaaggatttaa

SEQ ID NO: 385851 - DNA, 665 bp, Homo sapiens
caagtgcaaagtttatttaggcgaattaatagaaaatatcactttgtgtaataaaaggtgacattcatgaaggtgaaataattttaaattggtatgcacttaatacaattgccataaggatatgaaagaaaaatgagagagcaacaaaagaaagtacaactcaaaatcgtacatctctcagtaattaatgaagcaagcagacaaataccaggaaatatgtagaaattttgaagtactgaaaatacatatatgtttgtgtgtattgtgtgtatactatatccccaaattgtcaaattaatatttttccaatcacatatggaaaaatatgaaaacctgtacttgcaaattaagcaagtctcaatgtatttcaaaggattgctacaaaacacacagtattctctgaccacaatggatttcagatagaaatcagtataaaaggcatctttaggaaagctccatgtatttgagaattaataaacatttctaattagtcatgggaaaaagtcatggaaattaaaactgtcaaatcctattaaaatatgtggaatgcagctagagcagtatttagagagcatataggcagacctgcttagaaatgtgcatattagaaaagagagactaaaaatgagtcattcaatacacaaagttaaacaataacaaaatgg

SEQ ID NO: 385852 - DNA, 515 bp, Homo sapiens
gaaagaaaggtgaagcaagcaggattaaagtgtgagaaattaaactgcagtgttgtggccacaaaacttcagcatattttgtaggtgcactggagttgagagggcccttcaaagtcagatgaggctcatttgtgttgtcaaaaatggaaatggatagccacatgcagaagaatgaaatttgacctttatctcacaccatctacgaaaatcaactcgaaatgaattaaagactaaaacttaaggctgaaatcataaaattgctagtagaaaacaaaaaaaaatgcttcttgacatgagtctgggtagggattttttggatatgatatcaaagcacaggcaactaaagcaagaatagatgaatgaaattacatcaaacttaaaagtttccgcatagcaaaaaaaaaaaaaaaatcaacagagtgaaaaggcagcctatgaaatggaagagtgtatttgcaaaccatgtatcaggtaaggggttaatgtataagactgtcctacaactcaataacaaa

SEQ ID NO: 385853 - DNA, 124 bp, Homo sapiens
gggcaaaggtctcaggagagcagagagagccagaagtgggaatggagttaggggatcagggcctcatccctacctgaaagcggagtcccattgagtcacctagcaaaggttgggggtagtggga

SEQ ID NO: 385854 - DNA, 905 bp, Homo sapiens
gattcaatataattttattatattacaaaaaagtaaccaaaacaaacatggcagattatttgtaagatgccttaaacagtgctgggagcatagatttttccctatattaccttttatatttctgtatattgaaataagtcctaaagttttttattcttaaaggtagcacatgcaaagtgccaagcataaggcctagcatatagaaaggcctagcatatagcagctgcttaatatctagtagctgttactcaagtcaagacagcaaggttacataaaagtaccagttaaaggaaaaacagctatttaagcaaaaagctttacctaaacacacacacaaaatttaagagacaaaaaaatgactaaaaaggacattaggggaaaatgggactatttaatttaccatatttgctagcattttttatagcaaaagtttatttcaaggatgccaggatgtatatctgttatgtatgtacatatatacacaatatatctaattacatatgggtgttaattttaatttttttcatgagagcttaatttctgtctgctttccatgttgtaagtcatatggtcttgtttataaaatttagaactgcagatctgattcctcatttgagtcattcagacttttccacaacaaccaactgggacaacaaaaatataatgttcagaataaacataagtaggggatgaatgagaaagttattttatgctacaagctccaccaagaaaagatggaatgtgaaaaacaaacactcatttgaagagtccggagagtccgttcttgatgcttttcaagctgtgcaacaaaggttcaaaaatgcttttcaaagaacctgggactaattttgttgagtttaggtgacatgtttcttttagaaatttctgtcaggtgatgagctaaa

SEQ ID NO: 385855 - DNA, 426 bp, Homo sapiens
aagtaagagttgatatgatcaagattgagatttaggaaaatcatcctgtctcagtgtagtgaacagattgaaaaggacagtggtggatgtgagaagttgttagagtgttgcaagaatgcaggagtggttaagagaatggcatactggagagtggccaagtaacctgtgtccaaaaaaattaatttaaatttaaaatatatggtgatcattggcatattttctcagatttatttcactaaggaatctagtgggctaattagaaaataagggaatgaaattatgaataaaattctttgattaattctgttgtgaagggaagagagaaagtatggcaactactgtggaaagtatgttaactagaggaaagaaaaataagacctgaaaggcttgaacatgtttaaatgttgtcagtaaaaagggaggggt

SEQ ID NO: 385856 - DNA, 172 bp, Homo sapiens
ggtaggacagacctttcctgcaggggttggggaacctagctgttcttcccctgcaggaatgcctgagccatgctgtggggcaggccggctgatgtgtgctgcgtaccagcggtggggcatcagcccagtgtagtttctatcaaatttgaactgaggaagaaaataaaagaga

SEQ ID NO: 385857 - DNA, 352 bp, Homo sapiens
atccacccgcctcagcctcccaaagtgctgggattacaggcgtgagccaccgctcccggccggcctctcttaaacaataattcctaagcaaccaggaccttctgtgtgggtgtgcctcaacccatcttcacagtagcttcgcagacatatggggactgtagattctccttcatttctaccaggatttattgagagccggtgccgtagcatgccgcatgctaagccttggaaatgctgaatgaatggtttctgctcttagggaactacagtctgaagagaaagacagacatacaaacaaagtacattgtagggtgaccagtatgatagtagaagtatgtcctgaggtctccac

SEQ ID NO: 385858 - DNA, 658 bp, Homo sapiens
ttcactcagcccacggtccacttctttacatcaacacatgttactataacattctagtccacaagagagtgggcgttcttttagagttcatgtatttgaggcagcagatgagtaaccaactaaagcaaaggctgtacttgatagccaagaacaaaactggcattttccccctgttaatcaatgtcaaccctacaatctttcagcactgagaactaacataccttcatttgtgtaagcagcacatacagaaataaccaaagcagaactgaagcatgggtattgccaagaattggggaaaaagttagaaagcaaagatgggacgtgagtctttgttttgcctaccaaaagaaaggagtcctacttcttgggtggcagttgctgtagcaaccaaaccactgctaaaggagattcagagcattaagacggaggttgtggagaagggcagaagcctgggggactgagctctgtagcgggacactaggagcagtggtggtcccccaacccccacctgatgatgttgaacatctgctcaaattagagcttgcgtcttgactaacgtctggcaagaaccataaactcccaagccaagtatcagaaaagagctaagtggggtgtgagcaagccgtctcaccgcagagactttaaatgcttcactgaa

SEQ ID NO: 385859 - DNA, 354 bp, Homo sapiens
gaaaacagcaaagtgataaataatatggcaacagataataaaggaaatacacatattaaactttttgaatccaggatctttgaaaatagaaaaagcagtaatagctttttgcatttctgaggttttttttttttttacaagttactctagtttgtgtaccatataatcctgttatcttatctcttcctgcctaacagggattcttgtagcatttctagtgccttcttttgaactatgaatatcatctggccccctggataaagacaaggctaggcaagtcagattagcttgtgaaacaggacctctaggatgactacagtaaacaataatttcttgtacacttaaaaataacta

SEQ ID NO: 385860 - DNA, 421 bp, Homo sapiens
tggatgtgtggaggtgtggatgctgtgtggatgtgtggatgtgtggaggtgtggatgctgtgtggatgtgtggatgtgtggatgtgtggaggtgtggatgctgtgtggatactgtgtggatgtgtgaatgtgtggaggtgtggatgctgcatggacgtgtggaggtgtggatgctatgtggatgatgtgtggatgtgagtaagtgaggatgctgtgtggaggtgagtaggtatggatgctgtgtggaggtgtggatgctatgtggatgctgtgtggatgctgtgtggatgctgtgtggaggtgtggatgctgtgtggagctgtggatgctgtgtggaggtgtgtatgtgtggaggtgtggaggtgtcaggtgtggatgctgtgtgaaagtgtggatgctgtgtggaggtgtgtatgtgtgg

SEQ ID NO: 385861 - DNA, 1221 bp, Homo sapiens
ctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccgtattcaaatgaagttattttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgat

SEQ ID NO: 385862 - DNA, 1823 bp, Homo sapiens
cctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 385863 - DNA, 1675 bp, Homo sapiens
acaaaccctcgttggccccacagggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatgaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 385864 - DNA, 1870 bp, Homo sapiens
acaaaccctcgttggccccacagggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaagaacagggtttcaccatgttggccaggatggtcttgatctcctgacctcgtgatccgcccacctcggcctcccaaagtgctgggattacaggcgtgacaccatgcccagccggacttgtatgttaattgcagcactattcacaatagcaaagacatggaatcaacctaggtgcctgtcaacagaggattggatgaagaaaatgtggtgcatatacaccatggattactacacagtcataaaaaagaatgaaactatgtcctttgcagcaacatagatgcagctggaggccattatccttagtgaattaacagaagaacagaaaaccaaataccatatattctcacttataagtaggagctaaacattgggtggtcatggacaaagagatggcaatagactctggggactactagactggagggagaaaagaaggaaggaatgggagaaagggttgaaaaaccattgggtattatgctcactacctgagtgacgggataattcacaccccaaac

SEQ ID NO: 385865 - DNA, 600 bp, Homo sapiens
caattacagttaaggatgcagtgaagggagaaggacatggtggtcgggacacagagaggccaagctcagcctggacaggccggggaaagtgttcggcaataacagagtacaggaggccaggtgcttaacaaataagcagcgtgtcctggcggcaggcctgggcagaacatgcctgccccagtgctcccctggcccccggggatgggcggtcctccccagtccccctggaagtcaacttctcaatacctcccttgttccttcaggaggtgccctgctcacatgctcttccccagggtctctcgcctgggcaggtcatcatagtacggggactggtcttgcaagagccgaagcagtaagtatccagcatctaagtggaggggagggagcagcctctctgtgacagtcacatgctataaaacatcatctcttttaatctcctagcaccaccatttaatccccattttacagatgaggaaacagaggagcagaaaggagaagtggcccaatttggcagagcttatgaaggtcaggctgggactgggaccgacagccccactgctgggagcatcattcctgctggtacatctagtcaggcctagc

SEQ ID NO: 385866 - DNA, 1702 bp, Homo sapiens
acaaaccctcgttggccccacagggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 385867 - DNA, 1796 bp, Homo sapiens
cctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatgaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 385868 - DNA, 445 bp, Homo sapiens
tgagctgagaccgcgccactgcactccagcctgggtgacacagcgagactccatctgaaaaaaaaaaaaaaaaaaaaaaaaaaaaaagtctcactgtcctttgctatttgccagataaatggtgtctggagaaacgccagaccactggaggccctcctccatgtgccaactcagccccactccagccagtttccagcagccctattttgagagagggacatacatgtcacctgtaattaggaggctaaagttggcctcttgggggaggtacctgctgggtcctccttttcctctgactaacccttcagactttttcttaaccttttccagccctgagcctgccaaaagaactgtccttaaaatcccagccatttccatttatggagtgactactgtatacctctgtgcacaccccccattccaccccaacctcccagcccagccg

SEQ ID NO: 385869 - DNA, 413 bp, Homo sapiens
gtatgtcccttttcacatagggaaaatctcatgcgcttcagacattgatgaataatcactccaaaggattctaacagctctcttacttgagccaaggtattggtgaaatattggcaaaagagtttgtgattgggccgggcacggtggctcacacctgtaatcccagccccttgggaggccgaggcgggcggatcacaaggtcaggagatcaagaccatcctgactaacacggagaaactgggtctctactaaaaatacaaaaaattagctgacgtggtggcatgtgcctgtggtcccagctacttgggaggctgaggcaggagaatcacttgaacctgggaggcagaggctgcagtgagccgagatcgcaccactgcactccagcctgggcgacagagtgagattccgtctca

SEQ ID NO: 385870 - DNA, 441 bp, Homo sapiens
cgcaacacctctgccactgcaaaaaccacaaccactggaaactgcctgaggccacacagcaggctggcagcagataccagaccaggaacccacatcttctgacaaccttttctttctgtcctttgttcttttgttaatcaagtatgaattggttcactccctcccaggacatccttattgttaggaacctatgagatttcccttccatcccagacagaaaaagaatctcctcaggaacaagaaacccaaaccagcgtaagccaggggccagtggtactcagaggcacagggtagaatccttggccactgagtggtcctgctttggtaggtgttcttatgtcttccctccatgttgatggctgctgactgatttcagggtggtggtttcttgggctggggtgactgtggcaatttcttaaaataagacaacaatgaagtttg

SEQ ID NO: 385871 - DNA, 231 bp, Homo sapiens
attattaattatttttcaaggttctctagaaaaaaatatttcttccataaaacaaatcatttcgtttgtgattttgtggcaataacaaaagaatattgggaattgtctgtactggctgggcatggtggctcacacctgtaatcccagcattttgggaggtcgaggcgggtggatcacctgagatcaggagtttgagaccagcctggccaaaggctggtggtggcgcaggcc

SEQ ID NO: 385872 - DNA, 320 bp, Homo sapiens
gcctccaaagtaactgggactataggcatgtgccactacacctgtctaatttttctactgtttatagatatgaagtatcactatgttgcccacactggtcttgaactcctagattccagcgatcctcccgtctctgcctttctgctaggattatgggcatgagccaatacactcagcctaaggaaaactttctaaagtaaaacaattaagaaaaagaataacatctttttttttttttttgagatggattcttcctctgtcacccaggctggagtgtagtggcacgatctcagctcactgcaacctccacctcccgggtt

SEQ ID NO: 385873 - DNA, 382 bp, Homo sapiens
gcttctttctactagagggcaaactctatgacagctccaccaggagaactctgttctcctggagtttgtcctctagtataaagaagcagagagtgcaagtgaaacgaaggaacaagatatctgcgtggaatgggagttcacacaggatacagtggaaagcacagaccttgggaaagcctgtctagccagggaaggcctcttggaaaaggtgactttctatttaagacttaaagaatgatcctcggccaggcacagtggctcacgcctgtaatctcagcacgttggcaggctgagacgggcggatcacctcaagtcaggagttcgagaccaccttgactaacaaggtaaaaccctgtctctactaaaagtacaaaaaaaaaaa

SEQ ID NO: 385874 - DNA, 724 bp, Homo sapiens
accacactgcattattataaagagattagaaaaagaaaatgggcattaattttacttattatagaattccaggctctatcaatgaattgaatcctcttcacctgttccagtctctgctgattgattgtaaaagcccggatagcatttttttaaaatctttcccatgttgcatggaataaatatgtcggtgctggaatgcttaggaattttaaattgttcatatggtctaaaagggaaaagttatttgtttttaagattaacttcttttgagattattgctgtccatatttaggtttcaagtactgaatctaatgggagatttgtgcattgatataacagctgtttcctttcatactctgtagattatgtatctgcctaagagggaggctttgaatgtatcataatcatctatattcttaataatggtaaaaagttgtattcagaggatatctttaacattgtatcaacctaaatgcttcttttattaaatttggattaacatacttgcagatttgatttctttttcagttatttgaatatattttttcatttctatgaccatgttacagtttaaatatacaagcagtaaatgttatagtttaaaagtcttggtctttttccttaattttgtaagccatagaaattttaataagactgattatttatttcattttataagttgtgttttccctactaacggagccaacaaataaatattaaaagg

SEQ ID NO: 385875 - DNA, 463 bp, Homo sapiens
gatcactactagattgatagttactaatattttatttagcacttcattttatttatttttttgagacagagtcttgctctgttgccccggctggaatgcagtggcacgatcacagctcattgcagcctcaacctcctgggctcaggtgatcctcccacctcagcctcccaagtagctgggaccacaggccccagtacctggctaatttttttatttttaattttatagacacagtgtctcactatattgcccaggctggtcttgaactcctgggctcaaatgatcctcccacctcagtctccccaagtgctgggattacaggtataagccactatatccagccaactttctttcttttttttctttttttttttttgaggagtctcactctgttgcccaggctggagtgcagtggcgcgatctcggctcactgcaacctccgcctcctgggttcacaccattc

SEQ ID NO: 385876 - DNA, 340 bp, Homo sapiens
gagaaaggggcactttaagggttaaaccctcctgtgtaggccacctaccatcaggacccaccagccactgctcagatatgaacagggcaagagtaagatcaaagccagtttactctattttcattcattcattcattcattcattcctctattgaaaaaatatgtatgaaggcccccatggaccatcagcttgaagtgcaatgctaatgagtggctgtcactgtccttaaagagctctcagttcagtgagggaagactggtaagcaagcaaggaattgcttagctgtcatgccattggctgagtaaaataaacctggaagtagtttgaagagaaatcaaa

SEQ ID NO: 385877 - DNA, 782 bp, Homo sapiens
tcctgccttaggctcctgaatagctgggattacaagcatgtaccaccacacccagctaagtttttgtttttttagtagagagggggtttcaccatgttgtccaggctggtcttgaactcctgatctcaagtgatccacccccctcagcctcccgaagtgttgggattacaggcatgagccaccacactcagcccggattttaattctttgtttgattttgctaactagagcagcaaggacagtctacagtctttggttctaacttcaaaactgattttttctgatcagttttattaagccatatctactgaaacaaaaagtattcttgtacctctctaagatgcaacgctttaggattgaaactgacaattctctgaggctgcaaacatcaactctactgaaataatgctgtgattagcctagcggtttgctatcttttactatgaacaggagaatattcattcctaaaggtgatcccatctgatgattcctgtgaagagccgcagttcacacacacacttcagtgcattgatcgagagatcaggaattcaacttttgccacatctgccctcagggatagaaataatgcataccaagtttctctgtgaacatctttttaaattctgtcttccttcccagctcagactttcagtacccttcatgacttcatccagcagttctctatccatttttctgggggcacaagttattacttccccatctctcacccatgggacatgatggggtatgtgtgatttagtctattgtttatttaagaagaa

SEQ ID NO: 385878 - DNA, 404 bp, Homo sapiens
ttatagcgataactggtactgcctttgattaaaggtgagctatatggagttaagcatttttatactagtaactatttattgagaattttcagaattctatagctacttgtctttaacagttataagaggcatgtatttttttttccttcatggtctggaagttagttttctctttgtttgggtagatcggaatgagttgttgagctgtgttgaaaacacacatgaatcaaaaaagcagatgtattgtagaaatgtgatgttttcatgtttcgggaatttgaccggaaagctttatgtatgggttttatttttaacaaagcagtaagggcttactttttaccaacttgtgtgtgtgtaaagatgtatttgttcaagctttaagaataaacctgtcaatgtacaaa

SEQ ID NO: 385879 - DNA, 673 bp, Homo sapiens
aagtgggtggattgcttgagctcaggagtttgggacccgcccggccaatgtggcgggagtctgtctctactaaaaacccaaaaattagccaggagtggtggtgggcgcctgtggtcccagctactcatgaggctgaggtgggaggattgcctgagctcagagggcggagtttgcagtgagccatggttttatcactgcagtccagcttggcgaaccacttgttcttttttgcttgtttctttgtcttttgctttactttgcatcatagagatacgggtgaaaatttctttaaccctttaagtgtttctactttgtctcatatgctatacctcatttgttacttgggagtatactcttggccatgctattagaaatggatgatgtaaaaatggcgccccctgaagtcaagcaatgtgaaacatttgtaaatctctacaacaaatgccctaaattgtagtcgcttaattaaaataattattttctatttactgtaatagtcaacaggtaagaaatgcagtcttgcatggatgtcccactaaaaaatatatgccatcttttagtccgttgatacttagcatattgccctcatcttcatggacaaaaattggcaatttttctgtaaaatctctctttcatattactgatgacaaaattctgcactttatctgaggaa

SEQ ID NO: 385880 - DNA, 367 bp, Homo sapiens
tgaatacttgaaaacaaattcctggaagttgatacttttgcctaagaactgtgagatgtctgctgtctaaatcacaatggagttgcttatttaaaaatgaggcatttattgcctgactcctacatttattaaagtgttttcagtggaacctttaaagaactcaaaggcaaaaaaggggccatcgttttctatcccaggaagcgtcccattaatgttcctcgtataactcagcatgtgttgagtaatttctcatcttacattattatatagaaacccggaggccaactgaccacccaagcaggctgctttaggaagaaatagtctatctttgattgacagagcaagcccaacatgcagtataagagtg

SEQ ID NO: 385881 - DNA, 434 bp, Homo sapiens
taccccataaatttgtataaataataatataaaaggtctgtccaatgtggccacagtctgggaccaagtaaaaagtgttaagggatgaagaatctttaccctccaagttagaggaagaattttttcccagtcttcaatgtaaagcactgaaaaatgtggctttttcaacatttttgctgaaatggtacaaaaggccggaagagaaagcgctactgcagttaggaaaggtcaccaaaccccagcagctgctgcgagttggtctctcggacagggcctcatcattggttgaaaaaagttgatctgtttttcagtcctacgccagttcagtctagaatagtccaaaaatagaatgggctccctatgttcttttttatttatttcccaaagtggatattttaaaatcataaaggtaactaatttttaggtaaaacttt

SEQ ID NO: 385882 - DNA, 153 bp, Homo sapiens
agaatgaattggaaggtgttaacctctgatcctcagttcgcagcaccataaggtgggcatgataataatagtccccacctccccaagctgacagatgtgtgataattaaatgggcaaacatgcataaggtggctggagacggcagaccctcaa

SEQ ID NO: 385883 - DNA, 128 bp, Homo sapiens
agcagcttttcaggccgctcagtaaaccagctggagcaacacacgcaaatgagaaatgtgttgtcttcgaagtccagagaggcctgctagatgttatgcctcttttttgatgcaggaggcgccagatt

SEQ ID NO: 385884 - DNA, 746 bp, Homo sapiens
aatttgggaggggaggaagaggcagcattggctgctttgtttgtgaaggtggcaggtatggcaggaggaaggagtttgactccagtagagagcagagtgttgggatttaacctgcccttcccttccctcttcctgcctctctagttccctattctctactggtatagatagactggtatagatagaggaaagactgcctctctagttccctattctctactggtatagatagaggaaagactgacactcctcttcctttccattaatggctgctcctttgagtcagggctcctttccttccccatcctaggtcagcacagcagactcaaaggtttctcactggaccctgttctaaaagcaggtacagcctttctgagatttttcataagacttttacctgccaggaacaatggtaacagacatcaagaacaagatgtacaatccctggaaagcagatgaaggttaagttgctgtcctgttcacctgcccagtctctgtttcctgaatttccttccatttacagcaagaagcccattcatttatcctgaagctctcagtacttaggtgcttgtccttcttggtataagtcaacttggtgtacgtttcatttgagtgacagctagaaaagctccactcaatagtcaccttgattggaggcagaggccaagtcacttgccacacccaagtcaggttggtaaagatgcccattcccctccttcaatcctttttcttcagagtatttgata

SEQ ID NO: 385885 - DNA, 294 bp, Homo sapiens
aatttgggaggggaggaagaggcagcattggctgctttgtttgtgaaggtggcaggtatggcaggaggaaggagtttgactccagtagagagcagagtgttgggatttaacctgcccttcccttccctcttcctgcctctctagttccctattctctactggtatagatagactggtatagatagaggaaagactgcctctctagttccctattctctactggtatagatagactggtatagatagaggaaagactgcctctctagttccctattctctactggtatagataga

SEQ ID NO: 385886 - DNA, 1007 bp, Homo sapiens
ggcatggaagctccgcgccccttcccacagaccttgtcccgtgcatcgcttccatccggctcttcctgagttctggcccttgtagtaaacctgcagtcttaatctcaataagtatccaggctggagtgcagtggcgcgatctcggctcactgaaacctctgcctcccaggttcaagcgattctcctgcctcagcctctcgaatagctgggattacaggcaactaccatttttccccctctgtcttttgatgttcacctgacaagctcctggtggtagccggtagctctgacagagagcaaaagaaataaggggcggttttagctgataacctcaccagtcttcacttcggctcttccttcgctgccccttcagctgcggggaacttgctctagggcatcttggcaggagggagggcgtctgagggtactggtgcctgcagacttcaagcacggagagacttcttgaagcggtgctgcctggccacttggaaaaaggtggattaatttggggatatccgaggagccccagagggccattgtaattcaagatcttcagtaaacttctgccgcggagaaagaacccggccagtattgggaccatcgtggtgacgcaggattggaggaacaggggtttcggttgactgagaagttcctgtgagagaaacaggctcaaatagagagaatagaaagatgtcgtgaggagcccaggaaacaaaattttccaggggtcagggaatgaattctaatcagaacaaggagccagcaagaacttccagcctaggaggtacttttcaaaagaagcctgggactctaacccagcttctgagagtatactcagaattgttaagaatcaggcagggcgcggcggctcatgcctgtaatcccagcactttgggaggctgaggcgggagaattgcttgaacccaggaggtggaggttgcagtgagccaagatcgcgcccttgcactccagcctgggcaacaagagtgaaactctgcctcggaggg

SEQ ID NO: 385887 - DNA, 470 bp, Homo sapiens
tagagagaatagaaagatgtcgtgaggagcccaggaaacaaaattttccaggggtcagggaatgaattctaatcagaacaaggagccagcaagaacttccagcctaggaggtacttttcaaaagaagcctgggactctaacccagcttctgagagtatactcagaattgttaagaatcaggcagggcgcggcggctcatgcctgtaatcccagcactttgggaggctgaggcgggtggatcacttgaggtccggagtgtgagatcagcctgactaacaagatgaaaccccatctctactaaaaaaatacaaaattagctgggcgtcgtagcgcatgcctgtaatcccagctacttgggaggctgaggcaggagaattgcttgaacccaggaggtggaggttgcagtgagccaagatcgcgcccttgcactccagcctgggcaacaagagtgaaactctgcctcggaggga

SEQ ID NO: 385888 - DNA, 323 bp, Homo sapiens
ctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaagtatatgat

SEQ ID NO: 385889 - DNA, 702 bp, Homo sapiens
ctaagctgggccctcactgggatgtcaacacatctcttctcagaattgcctttgagaggaactttctcttcgggagtaaaatgtttaaggcttttgtccttcaggctaggtccttaagcaagggacttatacctccccagacaggtacctacctgagaggaatttgctccttcctcagccctcttgccacttcctttgttcaggcttctgctgttacctacatggtactgccatacctgcctaactcatcttcttgcttcagtccaacagtttttctatgatgcttctagagctgttatttaaaaggagattctgcctatgcaatgccccttaaatctcttcagtggttcttcattgctcttgggataaagcaccatttgcagtatcccagcctcccctctgggctctaacctcattagaccatatgttcctttggggctagaattgtatcttatttcttattctattccagggccataggtactctttgacagaatgaataaatttctctagttgtctgggattctttgaaactatttcctaaaggtcttcagggaaggagattcttccaccacctcaattcctgtggtcaattttacaagccctgagacttaggaaaggtgttctgcaggggacagagggacttagcacttactgagtggttaccatataccatataccattccatgctatattatttag

SEQ ID NO: 385890 - DNA, 253 bp, Homo sapiens
cacagccatgagaaggccacagtgtggaggtgggcattgtttgtgaaagtaggacctcatcactgcgttgatcacactagatgagttcattacattaagcacatatggttaaaagagcaagtcctaccaggaaatatgtatcaatgtacaggtcctttggaaactgttacatatgtacagtttggacatgcactaactacaaatgagatacagattctgggacactaatcatatttttagatgagctcaccgg

SEQ ID NO: 385891 - DNA, 373 bp, Homo sapiens
acaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgt

SEQ ID NO: 385892 - DNA, 243 bp, Homo sapiens
cattccttcattcactcatttttaaaagcgtcatatgtacaaatatatagtccagaaaatttttaaatataactgtctataaaagtatgtggcaaaatcccattcacagtcttattctccttccacagccaaacacttttaattcatttcttatatatcatttcagaatttatctttgcaaatacacatgtatattcttattctacccttctctctcaacacaaaaagtagcataccacacat

SEQ ID NO: 385893 - DNA, 297 bp, Homo sapiens
aaaagtctcactactacaatgaaatatttgcctgcctctacttacactttataccaaagttcaaagttaacaccgttaatcaccatccacaaaagcatgactaaccaagtgaagattaactagtcatttcctgattacaaatggaagtagaattttcccagtatcattgacagtgactattagaatgtgttgaaagtcccttacaatcactcttccaaaaatgctttaagacaaaatttaaataaaaattttattcactaacagctgtccaagattccaatacaaacataattctac

SEQ ID NO: 385894 - DNA, 495 bp, Homo sapiens
ttcaggcgattctcttgcttcagccacccgagtagctaggactacaggcgcgtgccaccacacccagctagtttttgtagttttagtagagatggggtttcaccatgttagccaggatggtctcaatcaagcttgacctcgtgatccacccgcctcggcctcccaaagtgctgggattacaggcgtgagccactgggcccagctaataataaagagttttaaagtgcagtgtggggaagttgtaggggccttacgtgctggatgctgggctgtgcttgctgggtgactgcccccaggagtagggaggagagcgggaaggaagggacacttatgcatctactgggcgctgggctggccatttgcttgagaatgtgcggtgaggccatgtccacgaagcaagaactgtctccccagcagagctggctgaacagacaaagaaataggcatgctgggccaggtaagcctcctgttcctgaggtgcacaggtgggggctg

SEQ ID NO: 385895 - DNA, 515 bp, Homo sapiens
aaaggacttggaaatcataagtgataaatggactaatgtgctccattttgtaaatgtttatctttgataaacacaagactttgtgcttttaagtgtctaacacagaacctggcttgaagtggatgttcaatgaatattggtttcctgaatacataagtgaacgaggtactcaatgtaatagcctaatagtctaaaataaaatactttcaaatgcttactttgcaacccctgactaataaagaacagaaatttaaaatgtacttttaagtctttgtatgtcttatgttggtggggattatttttaatgaagtaacacaaggtggaaatagtacaccagcagtggcttcattgaactgaatgctgtgtgggtgaattacttagctgaagcttctgcagtatagcagtaagaatagtacttccctcgtagggcagggggtaagggaattgtgtgaactactgcatgaaatcacttagcccagtgcctgccaccaggtaagcattcaacagctattgcc

SEQ ID NO: 385896 - DNA, 627 bp, Homo sapiens
attattattgataacttgaggatctgttctcagtataaatgacaaagccctgtcacatgccaagcaaaattctacgatccagatgctggtaatacaacagtgggcagataggacctttgctgtcactgccctgtcactatcatgtagttcatagtagaagcttatcagtatttttatggttttgttatatttatggtatttaattgttaaagatgtgttagatgctgtttgattgtttaaatttgcatttctcactcctgcaaatatctgatcatgccatacccttttcgcagtgggctatagaaacctaaaggctgttcttaaaactttgttttttaatttatttttgacacggactctcgctctgtcgcccaggctggagtacagtggcacaatctcagctcactgcaacctccgcctcccaggagaatcacctgaacctgagaggcagaggcttcagtgagccgaggccacaccactgcactccggccttggtgacagagactctgcctcgaaagataaaaataataatgaaagtaatattgggattatactgtacattctttcttacatgtatggtgaatatattttgacaataaatatctttacatcagttaaaaaaaaaaa

SEQ ID NO: 385897 - DNA, 1378 bp, Homo sapiens
tcaagccttcaaactatttaaggaagcaaaatagtttcctaaatgcatattgtttgtgagaatttctcattaatatcctgaataattctttttttttttttgagacggagtctcactctgtctcccaggctggagtgtgatggcgtgatctcggctcactgcaagctctgcctctcgggttcacgctatcctcccgcctcagcctcccgagtagctgggactacaggcgtccaccaccacgcccggctaattttttgtatttttagtagagacagggttttaccgtgttagccatgatggtctcgatctcctgacctcgtgatctgcccacctcagcctcccaaagtgccgggattacaggcgtgagccaccgcgcccagccctgaataattcattcttgctaagcttcatgttgactctatatatcatctaagaaagtattgttttgtggtccaaacctgttgccgtggttagtaaggctttcttaggtgtgaaatatttagatgaaattttctcttttaaagttctgtatagggttagggtgttggaaaatgctatattaataaatctgtagtgttttgtgtttataggttcagaaccagagtaactggattgaaagatggactgatagattagatatatcagtctaatttatcatgactgatagatctggttaagttgtgtactaaaggattaggagagcccttcctgtcacaaaagtgccactaaaacagcctaaggagaaaaatggcttgcttttctaaacttcagatgtatctgggctctaatcatatagacaggcttctgatagattgcaactgtaagtagaaacctacatatagttaaaatcctggtctttcttggtaaacagatttaaaatgtctgatgtaaaacatgccacaggagaattcagggatttgagtttccctgaatagcatatatatgatgcatcaaatgggttattactattttttaccatttccacttacataatgaaaaacaattcattttaaatatcacattattattttgtaagtcatggaaaagggcaattgaagttttcattatgaagttttcccaataaaccaggaattctaaacttgaaaaaaaaaaatagaattagccaggtatggttgcacaggcctgtaatcccagctacccgggaggctgaggcaggagaatcacctgaacctgagaggcagaggcttcagtgagccgaggccacaccactgcactccggccttggtgacagagactctgcctcgaaagataaaaataataatgaaagtaatattgggattatactgtacattctttcttacatgtatggtgaatatattttgacaataaatatctttacatcagttaaaaaaaaaaa

SEQ ID NO: 385898 - DNA, 1247 bp, Homo sapiens
tgacagtgagactccatctcaaacaaacaaacacctccaatgctgtatctcaaataccatgtctacccttcttcctgctttacttcatctattacacaagtaatacatactcattaaagaaaaagacaagcaaaatgaaaacaaaagtcatccctgatcccaccagtgaagagttactatcctaccaacatttttctaagcatatgtacaactttaagacaagcacgaaagaataatactcgcgcccagccctgaataattcattcttgctaagcttcatgttgactctatatatcatctaagaaagtattgttttgtggtccaaacctgttgccgtggttagtaaggctttcttaggtgtgaaatatttagatgaaattttctcttttaaagttctgtatagggttagggtgttggaaaatgctatattaataaatctgtagtgttttgtgtttataggttcagaaccagagtaactggattgaaagatggactgatagattagatatatcagtctaatttatcatgactgatagatctggttaagttgtgtactaaaggattaggagagcccttcctgtcacaaaagtgccactaaaacagcctaaggagaaaaatggcttgcttttctaaacttcagatgtatctgggctctaatcatatagacaggcttctgatagattgcaactgtaagtagaaacctacatatagttaaaatcctggtctttcttggtaaacagatttaaaatgtctgatgtaaaacatgccacaggagaattcagggatttgagtttccctgaatagcatatatatgatgcatcaaatgggttattactattttttaccatttccacttacataatgaaaaacaattcattttaaatatcacattattattttgtaagtcatggaaaagggcaattgaagttttcattatgaagttttcccaataaaccaggaattctaaacttgaaaaaaaaaaatagaattagccaggtatggttgcacaggcctgtaatcccagctacccgggaggctgaggcaggagaatcacctgaacctgagaggcagaggcttcagtgagccgaggccacaccactgcactccggccttggtgacagagactctgcctcgaaagataaaaataataatgaaagtaatattgggattatactgtacattctttcttacatgtatggtgaatatattttgacaataaatatctttacatcagttaaaaaaaaaaa

SEQ ID NO: 385899 - DNA, 243 bp, Homo sapiens
aaaaggaaaaaaaaaaaagaaagtaaaattatagggtaactagaaagttacaatagtgtaacaagcataatcatttagaagattttcacctgtaacgtggttaagataagtttgagactcagttcaattcaacacatttgactttcagacagatccaatgtagtctgttgtatttagaaagaattcagacctttataaggacgatttcatgacattaatgaaatttatgtgttaatggaactg

SEQ ID NO: 385900 - DNA, 186 bp, Homo sapiens
aagaccttgtctctacaaaaaaaaaaaaaaaaaattagccaggcgcggtagcgtgaacttgtggtaccagctactcaggacgctgaggtgggaggatcatttgggcctgggaggtcaaggctacagcaagctatgacggcactactgcactccagcctgagagagctaagactctctctccaaaaa

SEQ ID NO: 385901 - DNA, 338 bp, Homo sapiens
ggcacagcggggctgtcagcgccgctcccaggctaatccccgccccgcccccgccgcccccgcgttcccggggctgggaacccagcgcggcccggggcccgggcgccgctgccgccgcgagaggccgcaggccggccggaaacgaggggcgcccgccctgtgaacccgccctcggcccctcttccccgaggcgcccccagggctggggcgtctaggattggggcgagtgagcggcgcggctgggaccccgaggccgggagcacaactggacgcgggacgtcgggcccccttgccgccgtcctcggtcggccctggcagcgcaggcgcggggcgcgggc

SEQ ID NO: 385902 - DNA, 672 bp, Homo sapiens
ttttacaggctcatcagtggaagggacttgccttgtctcagaagaaactgcactttcgagtgatgccgaaacaggttgagacttttgggggactattgagaagggatgattgtattttgcaatgtgagaagaacatgagatttgaagggccagggatggaatgaaatagtttggatgttgtaccctttaagtctcatgtcgaattgtaatttccagtgttggagtcggggtctggtgggaggtgatgcggtcatgaaggctgatttctcatgtttaacaccatcctcttggcactgtccttgcaagagtgagtgagttctcattacatctggctgttaaaagtgtgtggcacctctccctgcttgctgctgctctggccatgtgacataccttcttttgcttcaccttctgccatgtgtaaaagctccctgaggacgcttcttgaagtcaagcaactgccaatgcaaagcttcctgtacagcctgcagaactgtgagccaagtcaatcttttttttcagtataaattatgtagtgcttaggtattcctttatagtaacgcaagaatgccataatacaaggcataatggtttgcattttaaaaatgaaaattaaatttttgtaatttatcatgaaaagatgaaatgtgttaataatgagcaatatctacatgt

SEQ ID NO: 385903 - DNA, 387 bp, Homo sapiens
tataaggacacttgtaatgggacttagggtccacccacatagtccaggatgatctccaaatctcaagatccttaattacatctgcacaggcactcttcaaggaaaaggtcacagcccagggttctggagaagaagatgtggacagatctttttgggggccattagtcaagccaccaccgcaatgtctgtttccccatcacagatcaatagccccatccctaattgcctggtcctgtgactgccacctcccacctcccctgagagggtaaggatatggtcttggtccccaggaagtggcagggggttctgtgagtcctggtgttggtggaagtcaggctctggaaggaccccggaggcgaaggctctggagggaggacccgacggaag

SEQ ID NO: 385904 - DNA, 850 bp, Homo sapiens
gaaagtccctgactggagttggcagccaagccaggccctggagtgggcacccagagggaagacaggttggctaatttcctggagcccctaagggtgcaagggggaagaacacccacccgcaaagccccgtagctggaccctacgttagcctgccctgctcggggttggcgatgctggaggtgggccttggaccagagaaaatgctttaattaggtgacaagcgggcagaggcctttgtctctggagccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatggtgcggctgctcagaagccaggtagcctgccctgggtgaagccttcgcgcaggtcaatgacggggcggaggggcagggcgcggtcccctgcatccccgatctggggagcggtgggcccaggggccatcgccttagccccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggc

SEQ ID NO: 385905 - DNA, 647 bp, Homo sapiens
gaaagtccctgactggagttggcagccaagccaggccctggagtgggcacccagagggaagacaggggaagaacacccacccgcaaagccccgtagctggaccctacgttagcctgccctgctcggggttggcgatgctggaggtgggccttggaccagagaaaatgctttaattaggtgacaagcgggcagaggcctttgtctctggagccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatggtgcggctgctcagaagccagccatccgcccggcccgggagggcggacgctgcgagactcccggccgcgccctctccttcctctcctccccaagccctcgctgccagtccggacaggctgcgcggaggggagggc

SEQ ID NO: 385906 - DNA, 850 bp, Homo sapiens
ctgcgtcttgatggtagtggtcccccgggcccagctgttttctctttatctctttgtcttgtgtctttatttcttacaatctctccttcctctcctcacaggggaagaacacccacccgcaaagccccgtagctggaccctacgttagcctgccctgctcggggttggcgatgctggaggtgggccttggaccagagaaaatgctttaattaggtgacaagcgggcagaggcctttgtctctggagccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatggtgcggctgctcagaagccaggtagcctgccctgggtgaagccttcgcgcaggtcaatgacggggcggaggggcagggcgcggtcccctgcatccccgatctggggagcggtgggcccaggggccatcgccttagccccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggc

SEQ ID NO: 385907 - DNA, 814 bp, Homo sapiens
gaaagtccctgactggagttggcagccaagccaggccctggagtgggcacccagagggaagacaggggaagaacacccacccgcaaagccccgtagctggaccctacgttagcctgccctgctcggggttggcgatgctggaggtgggccttggaccagagaaaatgctttaattaggtgacaagcgggcagaggcctttgtctctggagccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatggtgcggctgctcagaagccaggtagcctgccctgggtgaagccttcgcgcaggtcaatgacggggcggaggggcagggcgcggtcccctgcatccccgatctggggagcggtgggcccaggggccatcgccttagccccctggcgctggggctcggcgccaagtgacgggcggggctccaccttccagccatccgcccggcccgggagggcggacgctgcgagactcccggccgcgccctctccttcctctcctccccaagccctcgctgccagtccggacaggctgcgcggaggggagggc

SEQ ID NO: 385908 - DNA, 683 bp, Homo sapiens
ctgcgtcttgatggtagtggtcccccgggcccagctgttttctctttatctctttgtcttgtgtctttatttcttacaatctctccttcctctcctcacaggggaagaacacccacccgcaaagccccgtagctggaccctacgttagcctgccctgctcggggttggcgatgctggaggtgggccttggaccagagaaaatgctttaattaggtgacaagcgggcagaggcctttgtctctggagccggcagccacggcccccgctgacggcgtgggaaacagaccctgttccactccggtctccagccttggaatggttgccttcgtgcagtgcaggaggacgcggcagagggcggacgatcgctccactcgccgggaccaggtgcgggggccctgcccagccgctggggcgtggccaggctcgaagcacccaggtgtcgggggccgactctaagccctggcaccggaagagagagggcggcggattggacctcccggctccagcattgcaactgggcgctccgtctcctggtccacgcaatgatggtgcggctgctcagaagccagccatccgcccggcccgggagggcggacgctgcgagactcccggccgcgccctctccttcctctcctccccaagccctcgctgccagtccggacaggctgcgcggaggggagggc

SEQ ID NO: 385909 - DNA, 463 bp, Homo sapiens
agttttccatgtagtataggaatgtcaataaatactgattaataggtcaaatgtttgctcttctttccttctttgtaactgtctcgttatattaaaaatacagcacacactaagttatgtttaaatttgttaatattgttctcaacatttacaaggacagtcttcaacaaatggtgctggggactgggtgtagtggctcacacctgtaatcccagcactttgggaggccaaggcaggtggatcacctgaggtcaggagttcgagaccagccggaccaacatggtgaaaccccatctctactgaaaatataaaacttagctgggcatggtggtgggtgcctgtagtcactgctactcgggatgctgaggcaggagaatcgcttgaacccaggaggtggaggttgcagtgagctgagatcacaccattgcactccagcctgggcgacagagcaactctccatctc

SEQ ID NO: 385910 - DNA, 427 bp, Homo sapiens
  misc_feature (258)..(258): n is a, c, g, or t
  misc_feature (286)..(286): n is a, c, g, or t
  misc_feature (397)..(397): n is a, c, g, or t
agttttccatgtagtataggaatgtcaataaatactgattaataggtcaaatgtttgctcttctttccttctttgtaactgtctcgttatattaaaaatacagcacacactaagttatgtttaaatttgttaatattgttctcaacatttacaaggacagtcttcaacaaatggtgctggggactgggtgtagtggctcacacctgtaatcccagcactttgggaggccaaggcaggtgatccaccaggcgtgacacnctcacccagccctgtatgcctaaatttnttcaggcatccgtaggaattaattcatgggttaaagatttcttttaccatttgaggttttttttttttttaactcattggggatttgttatgttcccgtaattttttcccnctaacaatttcttagggaattaaaggttat

SEQ ID NO: 385911 - DNA, 271 bp, Homo sapiens
tttctctcattctttatgacagactataagaggattcatagtctccaatcaatttttcttcaaaatttggccttgcgtcatatgaatatgatggatttgacacatttatgttgatcaattttgttgataaaaatggagaggcatttaaaatctagaatttagaagaagaatgcaatctactgctttatctttaccatggaagtgggtatccttccatttttaattgtaattgaacttaatattatattcatcctattattataattacagt

SEQ ID NO: 385912 - DNA, 399 bp, Homo sapiens
gtttccttctacttcactggctgcatattttcaggatcctcgccggctgcttaatctctaaatattggattactcagccttccctttttactatctaaactcttctgaggtaacctgatcaagtcccatgcttttaaataccatgtatgtgctgatgttgctcaaatttgtatttcctatcctggctctccccagagcatcatatatttaaccatctctaccaggtcattaagttggtatcgcaaacctaacaaatctaggacagaattcttaaagacttccctctccccatctcagcccatacacctgctcttctcaatcttcatatttctggtatagtatcatcattcacctagttatcaggccaaaaaactagtcaaatctgatttttcttccttc

SEQ ID NO: 385913 - DNA, 337 bp, Homo sapiens
  misc_feature (248)..(248): n is a, c, g, or t
atacgttcacacttacatctctacaatttacatgtaacatattgtctttagtttaccaatagggaaactgaggcctgatcagagatattaatttgtgtaaaacagctcataagaggaggaggtaggattcatatctagatatttatgggtccaaaacccatgttttttcaaccaccattcccggcctagatacattttttagcctgggcattcacattcagttggtcagcagagtctgacaaattctncaccattccttcttctacttgtttggttcagccccatattatttcttgcctagattatcataggcagtttttacccagaatctcacttc

SEQ ID NO: 385914 - DNA, 4247 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctaaatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatgtctatgtcttctatttttatataatttcatgttctatgaggaatttagtacctcttcactgtgaaattcgaaataatgatttttataaaagcaaaactagaaatcttttaatgacaattttcattaatttcagggttatcatttttgagaaatctacaccaaagtggttttttaaaattacataactaaaaataaaccacactgtggatacatcttataaaactaatggaaacaatgtttttctatatgatttaattctagtgtaatatggatgaggtaagagtaagttatgatcaaactttttatgttcttaataagcttgcaattgagtaaaatagaatataaaataaaggtgaaataatataaaaaa

SEQ ID NO: 385915 - DNA, 4339 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaacactggtgttatgtttttgttttgttttgatttgttttgtttttcctgtgacagcccaaactatattgtattaagttcattaggacttacatctcatacgtgtatttttgtttcctcacctctaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctaaatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatg

SEQ ID NO: 385916 - DNA, 4472 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgactggctactagggaaataaatgaatgtggaattgaggatggaacaaagaattcaatgctttacaataaatggactgtatttgagagttcaagagaggattggagaaaataactgagtatgtaaaaaatggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaacactggtgttatgtttttgttttgttttgatttgttttgtttttcctgtgacagcccaaactatattgtattaagttcattaggacttacatctcatacgtgtatttttgtttcctcacctctaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctaaatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatg

SEQ ID NO: 385917 - DNA, 3635 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctaaatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatg

SEQ ID NO: 385918 - DNA, 3897 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaacactggtgttatgtttttgttttgttttgatttgttttgtttttcctgtgacagcccaaactatattgtattaagttcattaggacttacatctcatacgtgtatttttgtttcctcacctctaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatatatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatg

SEQ ID NO: 385919 - DNA, 2448 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgagtcaaatcagaaaattaatgcccgttggaccacagaggagcagcttctagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttga

SEQ ID NO: 385920 - DNA, 3430 bp, Homo sapiens
aaattcttagccaagtacacgggccacttaaccaaaaaagggaaggtggatttaaagaattcaaccctcttgagccaattcagaaatttaatgccccgttggaccccagagaagcagtttccagcagtgcaaggtgtccgcaaatatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatggtgatgcttctactttaggggaggagacaaaaagtgcttctaatgtgccatcagggaagagcactgatgaagaagaggaggtgtgtttgtgtatggaatttgagctaatatgagttgaggaatcaccattttgtgtggtattctgtaaggttaatttgtcaagaggactagctaaattgagcatgaaaggttgacaatacacttcttcagtggtgcatctctcgtgactcttaagtcataatgacatgctaagttctgattctagaagaatggagagtgtattgttctttcatagtcttatttttattttcagtgttaagctgtttacaaataaagatgcctgtttggtagcctcattggtttttggtttttggttttgttttgtttaaaataaaagaagcttgtgcttccaataaacactggtgttatgtttttgttttgttttgatttgttttgtttttcctgtgacagcccaaactatattgtattaagttcattaggacttacatctcatacgtgtatttttgtttcctcacctctaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctaaatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatg

SEQ ID NO: 385921 - DNA, 2989 bp, Homo sapiens
taatttttgtttcttctcagtgatgatgatgtagaagaaacacatccaatggatgggaatgatagtgattatgatcccaaaaaagaagccaaaaaagagggtaatactgaacaacctgtccaaactagcaagattggacttggaagaagagagtatcagagtttacaacatcgccatcattctcagcgttctaagtgccgtccacctaagggcatgtatttaacccaggaagatgtggtagcagtttcctgtagtcccaatgcagccaacaccatcctgaggcaactggacatggagttgatctctctaaaacgtcaggttcagaatgctaagcaagtaaacagtgcacttaaacagaaaatggaaggtggaattgaagaattcaaacctcctgaggcacagaccccacaggctcctcggacactgggtccatcacctcctgccccatcatccactccaacaccaacagcccctattgccactctgaaccagcctccaccacttcttcgtccaacactgcctgctgccccggctcttcaccggcagcctcctccactccagcagcaggctcggttcatccagccccggccaactttaaatcagcctccaccacctcttattcgccctgctaattccatgccaccccgtctaaacccaagaccggtgttgtccacggttggtggtcaacagccaccatcacttattggaattcagacagattcacagtcctcactgcactaaaaattaaattggacacagctgcagtaacttttcaccccatcattataccagtgctcatctgactgatgaaaaagaggaaagaataatcatttctagatactgaggctgcgaactagttctgtggcagtggactagcataagtggatgtctaagaaatttttcagttcactagactaaaatgttttacaacaaaaagcctccagttagcctcctttctagagtatatgttcagcaatgtgatctcataaaaggaaaaacaaaagatttaagtattctatataccaagtttttgttttgtttttactgtatttattttattgaggttctttatattcctgcctcttcatagtcaaggctcttagtacaggaatattgacttaggaattgtgaaaactccttaagtttcttaagttaaggatgtttggcttttttctttaattttttaaaaaccattttcctatgttaggagtgcaagaatagccagcatttccgattttgacatatgttcattttatgcatatttaagaaattatagctgcatatcccttctttcaaaaaatgttgcttttttttttaaaggaattttaatatattcctttaaaagaaagcaatttaatcaattgcaaagcaattatataaaaccacaaagaatgtactgaacctactaaccctttaacatacagtttagggtcctagcgcagagtccttgtttaaaggtcattgactcatcatctgtcagtaatgagaggattggaagaataattttgcatacaaatgaggacttaatttgttgaaatataatctctttaagttccttgaaaatggagttggttttttttgtttctaaatgctatctgcttttaactagtagttgcctacatctggggacttcagagaagaattatattttgttagttaagtagacacagtggttatggaagcatttctttacagtaccctttacgtgtttggtttctgaacttaaaattgccctcatacttaataatatggtctgcatttaatatgaaaggtgttttattgataaatctattgtactatttggatacatttgtgtattccttgcagccaacctgtattcgtgggattggtgtagggttaaatcatcaacattatttcataaaataagaatttgttctgtgttatctaaagatgtatcagtatattgtcacagttgtgctgttaactaaaaatgctgagacccctttttatagaaaaacaaaaagacatcaagtcttcttaattcaacccataatcattaagtacttaacaaagaatattttacaagtgatagtatttcaacaatgtgtaattaatatttttgatacagtgatttcatattggaatcattatttgtgcaaagggacagacagatcacttagattgctatactagtggacataggctaaatgtttgcacattcacattcttatcacgtgtagaatacttcacaaaatagtcaacatctaaggccctaatttatgttttgaaagatcatgtgttcccaaagtattccctattgttggctccacagccttaaagtgctatagatttaaattcattgattagttttaatttttaattttagactgtgtatttccataaataccctacgtactggcatatttgaaactctttttccaggttaggtccttttctttctcattgaatcatcttaaatagttcttggccctgaatttagctgatttaaaattcttaatattcaagaatttatacttattttttccttaaaagccacaggggacagttaaatatcttaaaatatctaaaacattttttaaagcacttagattgtcttacgtatgtgcatactatacctttacagcgtttattgtcttgtctcttgtcagtagaccttcagtacacagtatgtgggatatgtcagtcaagttggtcagcaccagcatctgtccagctgttcagtatattgtgattcattaaaaaatctcttctatcccagacatgggccaaggtgctgtatctgagggatgtgctgtaatttgatttacatgcattagagcacacagtagaaaaacgttagcttcattagtaatatgacacatgtatatagtgagatgtctttattgtgtgctttgcatattttgtaaatattttgcacgtcattatttttcttttttgtttaagcagtgtttggcctggaagagtgatatgcttgctgcttaatcaaaggattaaagatttaaagatg

SEQ ID NO: 385922 - DNA, 1394 bp, Homo sapiens
gagttgatatcttcccatccacccgccgcttctttcctccatctagcgatttttattttttaagtgtctcttcctttttctttcttttcttcttttttattttttatatatattttttggcattgctttgcagatgttgggatgagagtcggagccgaataccaagctcggatccctgaatttgatccaggtgctacaaagtacacagataaagacaatggagggatgcttgtatggtctccatatcacagtatcccagatgccaaattggatgaatacattgcaattgcaaaggaaaagcatggctacaatgtggaacaggcacttggcatgttgttctggcataaacataacattgagaagtcccttgctgatctccctaatttcactccctttccggatgagtggacagtggaagataaagtcctatttgaacaagcctttagttttcatggaaagagctttcacaggattcagcaaatgcttccagataagacaattgcaagccttgtaaaatattactattcttggaaaaaaactcgctctaggacaagtttgatggatcgccaggctcgtaaactagctaatagacataatcagggtgacagtgatgatgatgtagaagaaacacatccaatggatgggaatgatagtgattatgatcccaaaaaagaagccaaaaaagaggtaatgatgatcactagaagtacttgtgattgttctacaaatctgctgaaaaagaatgaacagtacttcgtattaagaaaaactttttaatgtaatgctttatgagatagtaaatttcagtgttaattagcaatacagtcatacctagaaccccagttaaccaagttgttgaaagttgaaaataccattgaaactggaaaaagatctgagtttgtttaaacttagcatttgctagttatgtgacctcattcagtttagtgactctcattcttctgaagaaacccaatgccatgggccattcatcaccttaagctctttcatcaatgttatttaaaaaattctcttctactgtaattttgtgttttactgattttctttctactgctaaatattctcaaattccttaattccttcattttctcccccaagtctgccttacctttgtttcccagaaacgtggtcccaatgatcaactattcgaatctccttctttcccatttccccattcctttaactccccacttcccttatccttctgctataccatccctaaccctgtaacctcatgatgctggattcgttgctattcacggtctaagagatgccccggaactggttccctcttccttgtcgtccatgaaacagtccagccctggaccctaaggcccattccctccagtctcctctcacagaccacgaggttcgcc

SEQ ID NO: 385923 - DNA, 180 bp, Homo sapiens
agtcttggcccttttcaatccactctctacaaagtacagtaaacttttaaagtatagatctgatcatgatatcctgtgctcaaaactcttcactggctcctttcaggaaaagaaccaaattcattaggaactggcccttgcttatctctccagaggatcataaaaaataaaactgggaag

SEQ ID NO: 385924 - DNA, 2786 bp, Homo sapiens
caatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacatgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaagattcttcaatgcatacacaataaaattgcagttcagtcaaacattggaagtctttctctaactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcact

SEQ ID NO: 385925 - DNA, 2732 bp, Homo sapiens
caatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacatgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaagattcttcaatgcatacacaataaaattgcagttcagtcaaacattggaagtctttctctaactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcact

SEQ ID NO: 385926 - DNA, 1713 bp, Homo sapiens
caatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaagattcttcaatgcatacacaataaaattgcagttcagtcaaacattggaagtctttctctaactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcact

SEQ ID NO: 385927 - DNA, 269 bp, Homo sapiens
gtccaccagagcttgctctaataagagtaagaccaacacggtcaaccccaagaaaccgaccccatagagaagaagtgcgctggcaggcacttggggcccactccctggtgctcctaaacagtgtgtccaaaccccggctgcccgcagcagatccaggtcatgtactccaggactgtagccacacctcactgcccactcctgcgttagcactctccagccttaccttgctcaaatagctcaccctccatgcaaaaataaaaacaaaagca

SEQ ID NO: 385928 - DNA, 482 bp, Homo sapiens
gggagtgaggtgagggtatgggacaggtgcagagaagggagagtgaggctactggcctactagagaagaacttgctgtgacctctgtgttcattacctgttgttgctataacaagtgactacaaacttggtggcttaaaccgatccagatttattatcttccctctctggaggtcagaagtcctaaatggctctcagtgggctcaattcaagaatgtcagcaggaccatgtttcttctggaggctccagggaggattcatttcctggcctgtcccagcatctagggactgcctgtgtttcttggctggtggtcccttcctccccttcaaagccagcgattctgtgtcttctaatttctctcatgcttctctctctctgtcactgtaaagacccttgagattacattgggcccacctgaattacccagcataatctcctcattgtaagatccttaacttaatcacgtctgcaaggaacccacg

SEQ ID NO: 385929 - DNA, 300 bp, Homo sapiens
atcagctgagtgccgttggaggaaaatgttcatgagatgcggcctgaggcctgtccccagcccaagctgggtctcctggcgactgcagcttggagcacctttggaaagcctcctgggacttgggatgtctttggggctgggaacaagtgtgggtggaggaagggccggtcctgtggtcacccagccctgtcttgtagggaaggaactgctggggtcccaggagaagccagagccaggcagtgagctccagatggtgggggagtggctgccaccttgaccatcttcccccgcatggctgtt

SEQ ID NO: 385930 - DNA, 2272 bp, Homo sapiens
cagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcggctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccgcaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtgagatctttggtctgtgggttatttggaagtatggtttaatttccaaacatttagggttttcctccagattgttgttgtttctggtttctggttttaattccactgtggtctcagaatatactttgctgacttccctctctttagatttgttgagccctgttttgtgcttcatagtgggagggtgattgtatgtgcacgtgcagatatgtgtggcccccacacggtatctccagctatccgtgtcttgcctctccgtgcccagtgcacccttctcagccctgccgtgtgaccctgggctgggccctccctgtaccctcctttgcaggttggcacagtgtttggctctgtcactggaaggagctggagggactccacaggagggaggggcctgccctcctggttccagtgtgcttgcttttcctggcttccgtggtgtgtgcctgccagcctcatggtgggggcgggggctctcagtgacagtctgcaggagtttagcaacacccaggttcattcaccacggtgggaaggattcctgctaagcttccttgcctctgtccagctcccagggcgtctgcctccctcctgccccagggagagcttctgggtgagtctcgctggcactcctgccccgggcttcctgctctcaggccttggcctgctgcaccttggccaactgcaccacccggcacatcatagccccactcaggtcagagctgcgtctcagccgacgtggggttccgaggttctcaccaagatccagactcaacgcttgtgggtttgttgtctcagtcctggcggtggaggttctcccgaggcctcagcgcctctgttctcggaagtctctttacatgttagtggaaccctctgttcctgttgaatcattcttcgtgttaaatgtttctatctcttgactgatacatgatagtcatcatgtatgtattctgcggctgcttttgattttttctctttatccctggttttctgtaatttgataagctttagggtatgtgtgtgtgttttgggggtttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcattttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaagttgaggcagggggattgcttgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaaaccctgtctctactaaaaatataaaaaattagctgggcacatgcctgttgtcccagttatttgagaggctaaagcaggagaatcgcttgaacctgggaggcggaggttgcagtgagccgaga

SEQ ID NO: 385931 - DNA, 344 bp, Homo sapiens
acaacaaaataagaatatgttacagagattggcctgcaaaaccttaaatatttactatttggccctttgcagaaaatttactaattcttggtcatattctatattaatagttactcttagcattttaaagacaatattccattgtctttcagcttccactgttgctgttgagaaatcaatatacagttactagtcactacttggtagaagtacgatttttttctctggctactttcaatatcttccctttgtgttagatgcctttcagtttcactttgaatttatgggtgtagatcccattactcaggaaatcctaagttattacctgaggatattgcctcttt

SEQ ID NO: 385932 - DNA, 429 bp, Homo sapiens
tgcatgtgtgtgtgtgcgtgtgtgtgcatgtgcgtgtgtgtgtgcgtgcgtgtgtgtgcatgtgcgtgtgtgtgcgcgcgtgtgcgtgtgtgtgtgggcgtgcacgctctaacatgcaagaaaggactagaacggtagcccccgacacgatgagacaactgatgggggtggaattattgatgatctgttttcctcttatgcaatgtttgactttttgcaatgagcttgtattttttaaattttggtgcgttttaagataggcactacatgctcatgaaacaaaatgtaaaatatagcaaaggggcacagaaaaaagtctgcctccctcctccctgctccatcagctgtcaggtgctgccccacagaggggccactgttaccagttccttactccccttcctgagatactcagcccacttgcagacccgg

SEQ ID NO: 385933 - DNA, 450 bp, Homo sapiens
ttttgtttgcttcttgctggtatccttcaggtcttatctctgtaaagtgcaggtgtcatttttaagagaactcaatcttactcttggcagagtttcataaaaatgatgtgttatgggcagaatatgcaaccatttgtgaagtgattttgcctccattctcttgctctgccctctctgagacatcatgaagcagacagagaatgggtttgtcatccccactttacagatgagaatgctgaggcccaagacctgctgctttcccatactcacccagtgggagaatggcagtgctgggactcctagtgcagtgctccctctgcggtagtagcagcaaatgctgctgtcgagatgagtggcaggagagactctgctgccttcattttggcccctgcatcactgcctgctgccagggcctgcagggaatctggccgagtcttccctgacctgggc

SEQ ID NO: 385934 - DNA, 436 bp, Homo sapiens
gacgtttcggagtcttgcagcctgcaggggtccatgtggttacccggaacaggaaccgtgggggtgctttccgggacccagggggcccgtgccaatgtttctgagtcttggagcctgcaggggtccacgtgtttaccctgaacaggaacatgcgggtgttttccggaatctggcgaggccgcgcggcagttttgcatttacattccttgttttgtttttaaggataaagcggtgctgggtggggtctgtgggaggggtttgagccatggcggaagatccctggtgaatggcttggatgtttgtcgcctccgagtctcatgctgagacgtgatccgtggtgctgggtggggtctgtgggaggggtttgagccatggcggaagatccctggtgaatggcttggatgtttgtcgcctccgagtctcatgctgagacgtg

SEQ ID NO: 385935 - DNA, 733 bp, Homo sapiens
caggagttggagaccaacctggccaacatgatgaaaccccatctctactaaaaatacaaaaaattatccaggtgttgtggcaggtgcctgtaatcccagctactctcgaaaaaacagaaacaaaaactctgacatgtagagtatgtagatgtagagaaaaaagtaaaatgattgttgaaaaaaatgtctattttttatcttctaaatagctttgtgtgtcagagatcagaacgctcattttacatgatatcaagaaccagaatgctagatagctagaatggttgttaacttcctagataaccattgtagaggaacacataaggtaaaacaaatgaataaaaattaaaaaaaaatgagatagccaaagatttgaagctctttacccattaacatgataatcatttcgactttgaatatttgtagaacaagagtcagaactcagaacaaagatctctgaggaaataaaaaaaaaatcaagctgcctcctaatttctcatttagtctgtcattgggcattgtcaaactgtcaaactatatttagagattctggttttcatctggagacttagtgagttgtgtaatatcttgaatacacatataagatcttgccaggtggggtggctcatgtctgtaatcccagcactttgggaggatgaggtgggaggatcgctggagcccaggagttcaagaccagcctgggcaacatagcaagtccctggctctatttaaaaaa

SEQ ID NO: 385936 - DNA, 677 bp, Homo sapiens
attttggttcagaaacaagactgccatgtatgtatttaatgcttattatgtgccaagcactattccaggtactaagatacagtgatggacaaaacaagatcccttctcctctatctcaggacttattaatttgggcattttcattttccaatataggatcttttagtactggtataggattcctgaaggaattcctgaaatataattatttttctgctagagcaaatcaattttgttttttgttttttttttgagatggagtttcgctcttgtcgcccaggctggagtgcaatggcgcaatctcggctcactgcaacctccgactcccgggttcaagcgattctcctgcctcagcctcccaagtagctgggattacaggcattagccaccacgctaggctaatttttgtatttttagtagagacagggtttcaccaggttggccaggctggtctcgaactcctgacctcaggtgatcctccaggctcagcctcccaaagtgctaggattacaggcaggagccaccacgcccagaagagcaaaattcttctgttgacaaaaatttctttcctctgaggaagagacactgtgtgcctgtgttttatccaggaattccattggatagtttgtcctttgggatgtcagtggattaaatcctccattaagaatcaaagtact

SEQ ID NO: 385937 - DNA, 481 bp, Homo sapiens
tcccaagtaggtgggactgcaggtgcacaccactacaaccagctaattgttgttttttggttcttttgtagagatgggggtctcactatgttgcccaggctgatgtcaaactcctgacctcaagggactgttccatctcagcctctcaacatgctgggaccacagccgtgagccactgtgcctggccttatatagaaattatgagccatctggaatagccaaagccccaggaacctgaatgaaaacagcatttcccactcccacaggtctctttgccctgtctcttgttcttagttttgcttccctcttgtctacagctagctcttgcaaggccttctgcctgccctcctgatccccgccctagccacttctctatggttttagggacccatccatccatgttaaccaagagagatttccccctgccttctctgagacctctggcatcaggaaccctgatgtcccaaagccttctgtggcc

SEQ ID NO: 385938 - DNA, 518 bp, Homo sapiens
gatataatcaccactgactgtttagtatagagatttctttttagcattttatgtttatgtgtgtgactactttttagaaaaatattgagtctagattatttatggcctgcttttcttaatataaccttatgtaatgaacattttcctatcaataaatatgctttacaacatgactataattaggagctatgatgcagttataccataatttacctgaaccagttcacttttttgaagataaagatatatatgtccatctatcttatattataactaatatttattaatatatctttgggtacaacctctgtgtagaccagtaggatatttttataagtataaattggtgggccaaagagtgtgagacacacaaagttttaaggcttttgaaatgtattggcactttcctctccagaagagttataccactgtacactcccaccagtagcacctgcctctccaggcttctctaacagtgggtattattcttattttactatgctaatttgataagcaaa

SEQ ID NO: 385939 - DNA, 190 bp, Homo sapiens
caaaagcaagtgcataataggaggtaacagttattatgggaggctttattgattgaagatccaatgaaaagggatttaattcatttaatgttccctggctctgttatactacaattctgcacatgccctttcagacagaaagtttccatctgtgttgatgaggtagagtaagcttggcctaggtctatct

SEQ ID NO: 385940 - DNA, 487 bp, Homo sapiens
ctcagcctcccaagtagctggaaccatggtgtgtggcaccaagcctggctaatttaaagaacgtttttttgtagagacggtggtctccctatgttgcccagactggtctcgaactcctgggcacaagtgatcccccagctttggccacccaggtatgagccaccgtgcctgaccatccaaatgttactttaattttaaattccctaatgacatatgacgctgagcatcttttcatatgctatttgccatatatgtgccttctttggtgaggtgtctcttcagatattttgcccattttgaaattgtgtagtttattttcttgatgttcagtttttggagtttattgtaaattttggatacaactctttatcagatatgtgttttggaaatattttctcccagtctgtggcttgtctttattctctaaaccgtagacaattttgagaatgcatgatcttaggaaatatagttctcatgagcccttctt

SEQ ID NO: 385941 - DNA, 199 bp, Homo sapiens
gagatcacaccactgcactccagcctgggtgagagagcaaaactgcatctcaaagaacaaaaaacagacacttttcttagatttttttctctttcaaacatcccatgaatactttaaatgtatgtaaatgtatgcatgtaacttacatctatatctagggtattcattttaacgagttagttactgcagcagtattata

SEQ ID NO: 385942 - DNA, 846 bp, Homo sapiens
taggaactaagtgtaggaaggtgtacagtggggtggtgtgggggtggaattgtggcagccagatggtgttggcctaaggcctcttggcccttgttaggacttggtttaccatggcgcaacacatccatgagattggcaaaaattaaaaagtctgacaacagaaaatctggtaatctggtgaggatgtggagcagtgggaattctccaatactgccagggagcatgggcatcaatcccaccacactggaatgcaaaggggcattctgagtagaactgaagatgtgcccatccttgaccccacagttccagccatgggcatgcgcatgaatgtgcacacgtgttgactgcggcatttgtttgtaattatgaaaacatctaagtttccatctatgggagaggggataatgtgggagtgcccaacagtggagttctagagagcagtaaaaataaatggactagagctgcacacgtcaaaatggatgaagataaaagacataaggatgggagaagaccacctggccacagaagtatatgtccaatatgatgctggtgtatccagagtgttcaaacaaacaacacaacactactcattgtttccaacgtgagtatgaaagtatggagcagtgcggagggccaggagtgctgaatccacatggttacttctccaggcgggggccgaggaccagggctggaggtttactccaggagcttcagtggtgcatgctgaatgtgctgtttcttgggctgggggacagagatgtgcatgctgttatacactctatattgaaatgattgtataacaatatactaatttatcatgtaataaatttgaccagaaagaaacaa

SEQ ID NO: 385943 - DNA, 571 bp, Homo sapiens
agacgttccatttcaaagaaaaaagagcaacacgaaggccctctttaaggagagagtaaacattcactttaggtaaaaaatagtcttttacacgcctgtgcacggcacacctcttttgctgttcaccttgagcccaagagtttggaaaggctgcccccatttcagagaggaagaaacgcaggcacacgtgaatgacagactcctctgtggtggcctagactccagccaacacttcctaggacagcctgccattgtgcaaagtcaccatgtaacaaatgcagacatctctgagatcaccatgcagtgaggaagtctaagctggtggcatgaagaggccacatggaaagggctaaaaaaggggccagcctcagtcatcccagctgagcacctagctgggaataaaagaggactccgtggaggtttactccaggagcttcagtggtgcatgctgaatgtgctgtttcttgggctgggggacagagatgtgcatgctgttatacactctatattgaaatgattgtataacaatatactaatttatcatgtaataaatttgaccagaaagaaacaa

SEQ ID NO: 385944 - DNA, 145 bp, Homo sapiens
gcatatttagtatattgatgagacagttatgctactgggttttataaagtggagttgcctcaaacttttcacttatgttttaaagtataaggtttttcataagttatatgaaaaaataattcttaggctaggttcggtggctcac

SEQ ID NO: 385945 - DNA, 5123 bp, Homo sapiens
  misc_feature (109)..(109): n is a, c, g, or t
  misc_feature (113)..(113): n is a, c, g, or t
  misc_feature (120)..(120): n is a, c, g, or t
taaagccacacagaggaagttacgcagcccggatcagaccgagagataaaagccccgatggtgatcgtgagtgatggcaagaggatttagcctcggcattaacttggancggntgcgggnggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccgggattgtgcctatgattggggggctgtttctcagtgcctggctcttcatggttggccagcacgtggagcactctgttcatctgtacatataggtgttgttgctaatgagctctctctctctcctcccctcttacaatgaaagacaagtcagaccccaggtacctggatggattgagagctgagatctcagaaacttcataataagttgccgatggctaccagccaaggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccgctgcaggttcctttggcacaactctcaggctctcccaggagctccatcagtgctgctttggaaaacgggacaggactttttgcaggtctcttggcccctgggtgggctccctgctcctcctgccacccacgccacttctctcacctggatctgggagagcagtctctcctgccagtcaagagtggggtgaccttcccccaccaggggcagaatccaccccctagcctaaccatgggggcagcctccctctgggcagcctctgcagccagcttgtcccagggctctgctcgtccaggtcagctcaggtcccaggggagtcggaccagggaggggcatctgcaggaggtgggggtcctgagagttccccaggagggcgagggcgacatggcgcccacaggttatcagtaaatgtcatcgagactgtccccagacactcacagggtgccaggcacggtctctcctttcagccttgcaaacccctccccctgggaggtcgccatctgctctgcgaggcagcaggagaggactggccaatgtcaaagagccagccgggagcagaccccaaatctcagagatgcttctggggtgcaccgtcaccctccaccagggctctgtggggccccacatcccacccaagttgtccctcccggacccagggggcccctggctgggaagccagtgagccgagagggcgccagaaagaagctggaccctgcagggacgctggtctgcacagccgtcgtaagttgcttctctgtggtgtccccaccccggcaaccccccaaccctctcttgcttttcccatctctcaccaggcatcagcaggtcccagaaagaccccgaccccaaaggccctgtggccactgcggccaccacagccatgacaggggcccctactactcctgtcccctccacgtccactgcctgggcccccatggcgcccagcaccccacagcccacaggtgggtgccagggtacagcgacccctgtcatcccaccctctcctgcttctagcctgggtccctgcctctcttggggtgggagggtcggcagccctgggcagagagcaggggcttggctcttagaatagagacgctagaaccctagagctgggaggccacaggccaaaggggcttgaggacacctgggtcaacctgttcctgagcccagccaggggattcagggatcagttcagcttccaaagtcgtcttcctcctgcccttcaagccattgcttggaagggctcccagaccattgtggccagacggctgcaggaactgagaggaaaggtgctgggggcagcgaggccatcctgacatgcagccaaagactggccttatctcccaatggtgcttctgcctccgtggtccctggagccccgcccacaccctgtccccacctggcccccagggcctctctgtccttagcccctcagcagcacaccggtgggatggatggagcagggttagcccagaaagcaaatgtctctgatcagcagggcaaagggagcctctggagctgagtttggacaccgtgggctgctgggaatgtggaggctgtgtgtgtagtgcaaggccaggccagggccagacgtcctgccccctcaggggtctgccacagacaggcatggaaacctgattctcgctcccctccaacggagggattcacgtgtattcaaggctgggggtgctggagtgggcctctgctctcacctggactcacctggggagtatccctgcactctgtgcagtgcaggtgccaggggtctgaaaggatttatccttcccagagggcaccaggaagacgatgaccaaggggaattcttcctggtcccagccagggaggggtgctccaatagcctgccacaccctgtcccccgccaccctgcagggaggacctggtggggactcctggccccttgggtagtgccctggccctccatctctctgatccaaggagacctgccccactgatccttcccccttggggggtggcatttctaaagggcagagtcccctccatcagctcctgcctcggcctgttgctgggtggacactcaggctccccagacaggggcaaatgctgagagaaagacctcctccttcctaggccatccagagcagctcccctgggggcagcacaccccacctctttctacatccttccttttctgcaggaggcatttacaggaggcaggggctagccaaaagattggaggatttccgggaagcctcctgacccaggaatcctctttggggtggaagacatgggtcactctgagaattctggacttcagacataggttggcccagccacaagggacctgtgctttgctgctgagcctgtggtgggcagacagaagcaaaaacagtggtggtgggtgctgtgcctgtctccaaacaggggtttggctgggaggccagatactctccatatcacatgtgcaagtgcacacatgcacacacacacatgcatgcacacacacaggcatgcacacgcacatgtacacacacacacacacagaggaatccatttgcagagctgcttctgacttggtgccagggcagccgtgggaggctgggcagattgtgcaaagttgggaattaaagaggaaaagtcagaggccagagtgggaaatgcaggggaggtgagggtccccaggaccccctcagtgagcagaaggcacaccctccctctcggcaagacagtgctgctctgcaccctcagccctgtatcaagaagcaggacattaggggaggaggtggctccaatgtgacagccagtggcccctacagcccacatctaggggctcctccctcctcttcagcaactgaagcccctgtccagagcccccattaatgaaaacgatcattgcagtagctgagggtgagttctcctgggctgtgctcgtatcattgtatcatcatatcattgtattctgggctcacagctccgtgagatggaggctgttattttcctagtcccacaggtgaggggatcgaggcttaggaagaagcagctggattttatgatatgtaaattacacctcaatcaagctgtttc

SEQ ID NO: 385946 - DNA, 3339 bp, Homo sapiens
  misc_feature (109)..(109): n is a, c, g, or t
  misc_feature (113)..(113): n is a, c, g, or t
  misc_feature (120)..(120): n is a, c, g, or t
taaagccacacagaggaagttacgcagcccggatcagaccgagagataaaagccccgatggtgatcgtgagtgatggcaagaggatttagcctcggcattaacttggancggntgcgggnggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccgggattgtgcctatgattggggggctgtttctcagtgcctggctcttcatggttggccagcacgtggagcactctgttcatctgtacatataggtgttgttgctaatgagctctctctctctcctcccctcttacaatgaaagacaagtcagaccccaggtacctggatggattgagagctgagatctcagaaacttcataataagttgccgatggctaccagccaaggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccgctgcaggttcctttggcaactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcc

SEQ ID NO: 385947 - DNA, 480 bp, Homo sapiens
ttgtgcctatgattggggggctgtttctcagtgcctggctcttcatggttggccagcacgtggagcactctgttcatctgtacatataggtatgggtccatctgcacctatagttacatgctcatctttgcctttaacaactttgacattctgacttgacagtcatggtattttaaagcaaccattaaatcttggctcctggggatgcttttgaaagtctctgacccccaagccggggcacttctgctgaactaacactcccataaatgagaaaaaaatgcatcaccttttaaataacatgcccgatctccaaatgtgcaactctgatattaataaaaataacccagttttctcgggagactttgctaatgcagcctcattttttgcacattttgccggagagcttttgttcttatacgtctctattctccccctctttaatttgttgcaggtgttgttgctaatgagctctctctctct

SEQ ID NO: 385948 - DNA, 990 bp, Homo sapiens
cgagaaagaccgagctggggttggttggaaagccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcc

SEQ ID NO: 385949 - DNA, 545 bp, Homo sapiens
atgacacttcactccagcctgggcgaaacagtgggatcctgtctcaaaaaaaaaaaaaaaaaaaaaaagagaaagaaagaaaagaaaagaaaaagaaaagccgttaggcttgaactttggggtaaaccacctcctcttcactcctcacaaacgactaactctatataacctgtttgtgatgtgttctgtgtgtttggtggcattaaaatattcagcagaaaagcaagcttggtacaatttttaaaattcatcttataaaatgaggaataattcaccataaagaagagataccaagtgtatgagtttaggaatcaagtggcaaagtgattgcatacagcaggtagattggctccaaagaagagtcccaaataactttggtgaagggacacaagtttgcgtgggtgaggtcatagtgagggaattggaatcccgttaaattgttctctgcatagtaaagagcaatagccagtaagaggtacaccaagatgcagaaaatgttcactcaggcacaaatgaaagcaaatgtaataaacagtttttgtaag

SEQ ID NO: 385950 - DNA, 749 bp, Homo sapiens
ggagggcagatatcttttcaagatagggagtttatttgctttcgatatatacacagaagtgaaattgctggatcatagggtagctctatttttaattttttgagaaacctccacactgttttccataatagatgtaccaattcacattcccaccaacagtatgtaaaggttccctttatccacatccacaccaatcttgttttgttttttgttttgattttttggcaacagccatcccaacaggtataaggtaatatcttattgtgactttgatttacatttccctgacgattagtgatgttgagcatcttttcataaaccacttggccattgtatgtcttctttagagaaatgtctatgcaggtcctttgcccacttttttttttttttctcaaagcagaaaatttattgcctacattctttgactacaatgctataacaacagaaatattttcttttacaaaaatctcaatcaccttaaacattttttaagtcactaaataactttgggtcaaagaagaaatcaaaactgcaaatacataaaagcaaacatcaattggcattgtatacattagaacatatgaaatagattatagtaaacaattattaaaacacaaagaatccaggatgcggaaagctgggatgagtattacaccctaacagcaacgatagcagataaactacaaaatcataacttttcctaaactcatttgagaactgagatcatagggcaatcaaaaagtctaaaa

SEQ ID NO: 385951 - DNA, 191 bp, Homo sapiens
gaaacaagggccctgtggctagtccttgtttgacccttccctcccttggcttaacacagcctttggcaaaggtcataaccaaagcagcctgtactgaggaaaagctctgtgctgagtgcttttgtgtgcctgattccatttaaacctcagcaaccctaggagggaggtactattattactgtccccattgt

SEQ ID NO: 385952 - DNA, 457 bp, Homo sapiens
cggcacgaggcctaaagaggtcctgaccaactcagaagttatagaaatcaaagaaggtatgcatctaaaatgctctctataaagagtagggagcatagtgtggtaatgaattaaagagtcagagagacctcgactgagatatgagtcagttaaccactcaatcacggagcctctgctctatataatggatatcacataattccacctttgtcagggtgttggaagtattttaaataacactcaggtgatactgaataataagatgctacaataattatcattctccaacaatttgaataactattcttcaaaaatttgttattctcaaaagtttataggttttgcattattccagagcgggcatggcaaaggaatacagtgctttattggggtttagaggtcccaatcagttgatataaatgttacagggtagtattaatgttttagaagattccgt

SEQ ID NO: 385953 - DNA, 423 bp, Homo sapiens
gggtattagaatatttccaagggacagtgataaagggtagaagataggcactctctttgggtggaatcttttgtatttgcttcttttaaggtgtgccccaagtccccaaatggctcagttgtcaccaaagcaagtgtaacaactcatccctcatgttcccttcacgatcaacagatttattcattttcaatctccaaatgctatttgaatgggcaaagatctcttaaaggacctgggaaaaatttgtacaacatggaattggactggtttgtgttctgggttttggccagttgttttcaatgtatgagaactctagtactccatgctatttcaagaaaaggggattaaaagtaatgccagtaaggtggagacaatgcattgcttggtcagcttagggaggaaaaacaatagaactaccctttg

SEQ ID NO: 385954 - DNA, 277 bp, Homo sapiens
atagcatgaccctcagtaatccctatcacgcaggcaggggtcaagtggccaagtggtgctctgtgcaccatcgtccggtcatggttagcacattcctgccgaacgccttcctccactcggccaagcagaagcacccccactcccatcacccatcatgacctgctgtgggatggctcctctctggggtcttccatgggcctggctcaccattgtccagcgtcccacaatcctttatcaggtttgcttccttcagctagccttctctccagctgccgct

SEQ ID NO: 385955 - DNA, 330 bp, Homo sapiens
acaaaacaaaaagtagtagcatctctgtgagaggtacacagttagaaaaatgattccacacacgagtaaagagatttaccaggaagagtcttgttttctaaaagttgatacaactagtagaaaaatacttgtcagtggtaaatagagcagaagtagaaaaagcagttaatctattagatcagatcagagtgtaaggcaggtatatcaggccaaaggtgataagacagagcagaaataaagtattgttaattcatgcatttgctgactcatttatttatacattgatactgtcacttataaatcaaatcttacaggtcaggttctgtgcta

SEQ ID NO: 385956 - DNA, 1668 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcaggagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggaaaaaa

SEQ ID NO: 385957 - DNA, 1713 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcaggagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggaaaaaaaaaaaagtcgacgcggccgcgaatttagtagtagtaggcggccgc

SEQ ID NO: 385958 - DNA, 1666 bp, Homo sapiens
  misc_feature (90)..(90): n is a, c, g, or t
  misc_feature (92)..(92): n is a, c, g, or t
  misc_feature (96)..(96): n is a, c, g, or t
  misc_feature (100)..(100): n is a, c, g, or t
  misc_feature (119)..(119): n is a, c, g, or t
  misc_feature (122)..(122): n is a, c, g, or t
cagtttatccagcagtgaactgtcctagcgcaagagttcgtaacttgctcccctgtcccttcacctccccacttggagctcagattgttntntgtntgtntgtttgcttgctttctttngtnctgttttagagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggaaaaaa

SEQ ID NO: 385959 - DNA, 1186 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagaggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggaaaaaa

SEQ ID NO: 385960 - DNA, 1061 bp, Homo sapiens
  misc_feature (90)..(90): n is a, c, g, or t
  misc_feature (92)..(92): n is a, c, g, or t
  misc_feature (96)..(96): n is a, c, g, or t
  misc_feature (100)..(100): n is a, c, g, or t
  misc_feature (119)..(119): n is a, c, g, or t
  misc_feature (122)..(122): n is a, c, g, or t
cagtttatccagcagtgaactgtcctagcgcaagagttcgtaacttgctcccctgtcccttcacctccccacttggagctcagattgttntntgtntgtntgtttgcttgctttctttngtnctgttttagagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtgagtggctgtggttgtgcagcac

SEQ ID NO: 385961 - DNA, 583 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcagggtaggcacgggcctgcaggtagggccggaggacgccagtccgcgggccggccccgggttcgaggccggagctcggcacccgggcgggacggctgggctcgatcccttggccacagccttctcggggacgcggggacctcagttcccgtgtcaaggccggtgggaggtctccggggtccggcacacataggcgcctctccgagcctcggtttccccacctgtgaaactgggtcatcccattgccaacctgatggggcttctgggaggattcaggaggtggctggtgcagaaaacgcctgacacacagtaggcaactgctaagtggccaatgcccttccccaacctccttctcagagcggctctgcctgcaaaataattttgagacagagtcttactctgtcacccaggctggagtgcagtggcacgatcttggcttactgcaacctccacc

SEQ ID NO: 385962 - DNA, 1423 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcagggtaggcacgggcctgcaggtagggccggaggacgccagtccgcgggccggccccgggttcgaggccggagctcggcacccgggcgggacggctgggctcgatcccttggccacagccttctcggggacgcggggacctcagttcccgtgtcaaggccggtgggaggtctccggggtccggcacacataggcgcctctccgagcctcggtttccccacctgtgaaactgggtcatcccattgccaacctgatggggcttctgggaggattcaggaggtggctggtgcagaaaacgcctgacacacagtaggcaactgctaagtggccaatgcccttccccaacctccttctcagagcggctctgcctgcaaaatagtaagttataatataatgacccagccactttgcacaaagatgctgaaacaggatgccctgtgctatgtgggtgctcaaaacggggtagtcaaatgggcatgttgagctcattcagttcttttgaaaccatactgagtaggtggaagcagtagaaatgtcccctgttatacagttgagagagtccaggctcaaagaggttaagtgtcttgcccagggccacacagcacataaggagtagagctgggattggaaccttgcttctcatgcagggaggaatgaatgcaataacaacctccacatttaccctaaaaaatattaatagagcttttattgagcacttactgtgtgtgccagggttgactgtgtgacctctcatcaacaactctgtaagctgatgatagtaattataataagagctaatagttattaacttcttaattttttactaatttatgaactacatatcattatgactccccgtcttttttttttttagacagagtctctctctcttgcccaggctggaatgcagtggcacgatctgagctcattgcaacctctgcctcccagattcaagcgattcctacctcaccctggtcaagtagttgggattacaggcccccgccaccgtgcctggccaatttttgtctttttagcagaaacggggtttcaccatgttgaccaggctggtctcgaactcctggcctcaagtgatccaccttccttgaactcccaaagtgcacaaagtgctgggattacaggcgtgagccactgcgcccggcctgtaacactcattttagagatgataatactgaggctgagagagtaaaacagctgcctgagaccacaatgtagggagttttagggccctctgattcctctgccctctgtttcctaccttcaggaaaaggagcct

SEQ ID NO: 385963 - DNA, 1396 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtggcacaggtgacttcaagggatggccggctcctctccaccgtcatccgtgccttggacacaccgagtgatggtcctttctgccggatctgccatgagggagcgaacggggagtgcttgctgtccccgtgtggctgcaccggcacgctgggtgccgtgcataagagctgtctggagaagtggctttcctcatctaacaccagctactgcgagctgtgccacacggagtttgcagtggagaaacggcctcgacccctcacagagtggctgaaggacccggggccgcggacggagaagcggacactgtgctgcgacatggtgtgtttcctgttcatcacaccgctggccgccatctcaggctggttgtgcctgcgcggggcccaggaccacctccggctccacagccagctggaggccgtgggtctcattgccctcaccatcgccctcttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggaaaaaa

SEQ ID NO: 385964 - DNA, 1050 bp, Homo sapiens
agcgggggcggtgcccggacgcaggtgccggccggagcggagctagtggcgccgacgggccgggccgggccgggaccggggccgaggcgaaccgaggggcctgtgcggccgcccggcccggccgcggatcaggagactggagactgggtcttgctctgttacccaggctggagtgcagtggtgtgatcatagctcactacagccttgaactcctgggctcaagaggttgaggctccctcctcagcctcccaagtagctgggactacaggctttcagcaccatgcctggctaattcaaaaaaaccttcagagagatagggtctctctatgttgccctagctcgtctcaaactcctggcctcaagtgatcctcctgcttggacctcccaaagcgctgggattacaggctcctggaaccatgggcctcaggccctgaggatacggggctcccggtggccatgacgacgggtgactgctgccacctccccggctccctgtgtgactgctccggcagccctgccttctccaaggtcgtggaggctacgggcctcggaccgccccagtatgtgacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttttttgcatatggaggacaggtggacatggtcctgagctctggacggagcaggcaccctgatctcattctgaggtccacatggcaccttctgggccagcagctgtggccggtgtatcaagggcgcccttaaagctggaacattccagcaagcttcttgcgcttctctgcacccggcaggcccactttcctggcaccctcgactttatataaaagttgcactgcgtttcaaaaacccacccctgaatgaataaaaggagccctggctggaaaaaa

SEQ ID NO: 385965 - DNA, 1087 bp, Homo sapiens
gtagggggtgagttgcaggggctgggacagagcaccagcatcctgcatcattagcagcacgtgggaaccctagtgtatgggtgcaaggccacttgcctcagttttccaggcgttcccaggggcctccatttctcatcttgaaaaaagcagcaaggctttggtaccagagggtcttggtgtaagtgcaaatctgcttcagatatatattagctgtggatttggggctggttacaaggcttatctgagcctcactcttttcttgggagataagggaaaatagtccttgcctgatgggctgcagtgaggattcaattaggcaatgtcccttagagctctggggagctgtgaaaccggtgatgccaggctgatgtctatgaaatgcactgggagtgaggaaagggtcacagatctccgcctgggtgttggaatatccagggaccgtgggaggctcccgggggccccatgctagtgttctccaccaaagacagaggagacaggtgatgtgcatgggagagctttgccttcctctctcacggaaccacaggctgtcagagccttgctccgcagcttcagtttgacaacctcagagaaccataatgatataggagttaaaaagaaattactcgggcagatagtgagggtatggaagtccttggtaagattttccttttaatgaaaagcagcccctaaatccttttctaacaaaaagcagctgtcagcagttgtgtccattggaatgtactaccctaagactaagcatgttcaaaatggcggctccgtcttctctttttgccagctatgagtgcagtaaggagaagacaagatggccaagtggaaagtccatttgcataatcagatttgggtggggtggccagcctttctcgtgcactacgtaaacgtcacacctggtcaaaccaatctgtgagccctatgtaaatcagacaccacctcctcaagcctgcctataaaatacgctgtggtccaccacttttcccttttcagatgcctctgtctcacgagagagagagctgctctcctctctcctttcttctgcctattaaacattctgttccttaacccacccaca

SEQ ID NO: 385966 - DNA, 377 bp, Homo sapiens
ttcgagaccagcctggccaacatggagaaacaccgtctctactaaaaatacaaaaattagctgggcgtggtggcgggcatccgtaatcccagctactggagaggctgaggcaggagaatcacgccactgcactccagcctgggcgactgagcgagactgtctccaaaaacaaaaaacaaaaaaaaaacacctcgcttttttggtgatagtcactgtgtaaaagttggaaaaaaaattaaaattacaaccctagacaccgagggttgtacggtgggaggtaattttaatattttttgtattttattttccaacgaggttacaaccctaagccacacagggttgcggcgtgagcgtcgggctgcgggggcgcctccacc

SEQ ID NO: 385967 - DNA, 1079 bp, Homo sapiens
tggtgagaacaagggcccttagacatttgtgacttgtcacttgtggagtgtctgggggacacaggaggcagatcttgctagttgggaccaaggaaaagcctcatagacctcagcagcaggtcagggacttggcctccatagctaatatgaaaggtaagcagtagatatcacaggagtcactggaaatagcctgagttagcctggacaacatagtgagaccctgtctctacaaaaaaaacatttttttttaattagctgagtgtggtggcatgcgcctgtggtctcagctactttggaggctgaggtgggaggatcacttgagcttggaaggtcaaggctacagtgagctgagttcatgccattgcactacaacctgggcaacagagtgagaccttgtctcaaaaaacaaaagaaagaaggaaagggaaagggaaatgcaaggaagaaagaaagaaagaaacgaaagaaaatagcctgagtttgaaaggcccggagacacccaggtgggctgtgagaggggccagcagctttgacacagcaggctgtgcccacagaggaagcagacagctctgagggatgcagcacacagcaggccgccccgaatgaccgcagctgcaggtgataaaatggctgtccagtgggagacagggacgggccataactgctgctttgtgctgtatctcttgcttgttaacatgtttgggtgaattgactgcaacagatgggcctttcagccctcagcaccttggtttctaggcaagaccggggtgacttgcaccttggcgaccccctcccctccctgagcagcagagcaacctgcgcataaagaagcctgagaagattggagtgggacgaggcgcagtgccctgtgggggtggaaagagctctggactggcagtgcaaagccagggctaacatcccttcgttctcctgatcttgagcacatcctccccactctggtggccacagtttccttatctattgaatgagagggttcaattagtgtcatcttggaagtttctattgtctgtattgtgtgtccatgattgtgtctatcgagctacccttgatgaacaaaa

SEQ ID NO: 385968 - DNA, 671 bp, Homo sapiens
atatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatg

SEQ ID NO: 385969 - DNA, 529 bp, Homo sapiens
aaaccagatccttgctagaaagtagcagatattttagctgaatcatgttctactatcaagtagaaagcaagacttgcaaggttaaacttgaatatataactgagaaagtttcaagtgaggtgttgagggtgaagtatggtttttccttgttccttatagtaaaatataaaagaaaagagataaactgaagatgaaacttctgtgtgagaaggaatcagcacttgatgatgtggaagattcttagcatatctacattgcaaaggatggaagaattaggaatttcactgttggaagagcaaattctaaagagagggtcaaaggtatggctgaacaaacttttgttgaaaaaattaggtgtgtgattcatggatccagtcaaccatcttaggagaagccagaaatagaaatggagttatttcagaaatgcacaacctttttctaatggtgcagatcacttcatacatagtagacccacaatgtttttgaaaatgttatataagcataaacattggcagcttggattgaaaga

SEQ ID NO: 385970 - DNA, 1196 bp, Homo sapiens
tcaaatctacaaaataaggaactttcagcgttgttctcttcatcctgttttctatttccaatgtaaacatttatttttgtttgttttacttaatactttgaaaaaaggcaagaaaatgtgaatatatattcgcaggtcccctttcttagataaatggtagtatactatgcacatttttattatctcacttttttctgaagattgttctataacagtatatagagatattcctcattcctttcttacggttgcatactactcaaatgcgtaaacattttatagtttgttctaccaatttccttttgagagcatagtgctataattaatagtcttttgcatacttttttcatatttttattggttatcttttggatagattcctagaaatggaattgcgaagtcaaagggtaaatgcatacgtaactttgctagacatcatcaaatatccctccagaggggtagtatttcagaggggtaatatttttcccaccaggaatgatgaaggtgcctgtcttctcacagccataccaacaaagtatgttgtggaatattttttttaaccaatctgaccgatgagaaaggcctttcagggtagttttaatttgcatttctcttattaagaactaggttgaagagattttcatatgattaaggctatttgcatttcttttttctgtaagctgttcgtatctttggcccactttcctatagggttgttagtcttctctctatttttagaatatctttacacattagagatggtaatactttgcccatcatacaaattgcaagtattttctcccagtttattacttgtcttgattttacttctcgtgtttgtttgtttgtttgttttgccatccaaaggctgcttttttcgtgttttttctgtttaatgtaagcaaactttttttcttcttgcttccagattttaatcatagaaaatcttacccactctcaggttataaagaaattcacttatgttttcttctaatacttacatgactatattttttacattttagtctccgattcattcagaattgatcctgcagtttggtgtgaggaatggatccaatgtcttatttttctatatggtcaaccagttatcgtaacaccttctattcaaaataatatctttcctcactgttttgcaaaactacctttattgtacaataaattgccacatacttttg

SEQ ID NO: 385971 - DNA, 271 bp, Homo sapiens
cccaaatgcactgaccctccctgattccgtcacacacgctgtgccctttgagcctagtcaccctctgctcctccttcaagcaccgcctgaatcttgggaagcccttctctgcggtgcttccccttgcaatcacccccactcccacccagggatctgccccactcctccaggtctgtggcctgtttgtccttgtgcgccaagagcctggcagagagatgggacaaggcagacttagagtgggaggaggagaaagaaaaacaggtcccacccc

SEQ ID NO: 385972 - DNA, 275 bp, Homo sapiens
gggtggccttccaatgccacaggctgcctccatgactctgtaatgtgaacaaatggttcaaagttggggtcttaaatttccccaaagggcttgagcttttcccagccaggcagaactctgcagttctatctaataggagtctgataattggccaccttaagatgctacagaccaagtccaactatgaagtaggaaactggccccgggggctcacacctgtaatctcagcactttgggaggttgaggcgggcagatcacttaggagttcaagacca

SEQ ID NO: 385973 - DNA, 761 bp, Homo sapiens
tctatggggtctcactgttccctcaggttggtcttgaactcctggcctccagcgatcctcccgccttagcctcctaaagtcctgggattataggtgtgaaccacagtgcctggccacaagtttatcttttagaaaatggaaattatttttaagttataatttctttcttgacagtgatgtgtggcatttaagaagtcagtaataaaataatagtgtacttccctgttggggcttttcatattgttttctattcgtcaatattgttgattcttctctccgtccctcccctgggacatgggatttagaacagtgtcggggtccttgtagcccactgctcagctgtcctaagggaggcaggccagctgccctgtgctctcactatcaggaaatgagccaatccgagatctctggccagtttgatttctatgatacacacatgctatgaacacagaggccacttcaattgagcccttatttatctacatgcctgagtatcgttttaaaaatatttttattgattgataagtgtacatatttataaagtacatgtgatattttgatacatgcataaatgtgtaatggtcaaatcagaaattcaggatatctataacctcaaaaatttatcatttctttatgttgggaatattcagaaaccattaagtgctcttggtcctggaccaggccctgtgctgactggttaatccaagttctttccattaaacctcacaataattagttttgtgatgcctgatttatagctg

SEQ ID NO: 385974 - DNA, 677 bp, Homo sapiens
tgtaccttagagaatacctgagtgggctgtcaatttcaggaaggggcactgcttcaggggctatggaaggaatagatgtgtgattcacccacgggcctgcacttcacacctcggtgtgctgctctcaccatgcagatcccatctgtgtctctaaggcttgctcctggagctggtggcaacttagtcacagaggaaatggccttcctgtcactgccatcatttgctacttgaagagaggtaatccttcacgcatttgctttacttgcaatgattatacaagggcagactctctctggggagcaaatcctgcctgggaagccttcttgggaacaaggctgactccagcaacctgttagatggccaggatagccctggggtgtggatggttgaccacagggcatgtgcctctgtcttgctgtttgtgacctggttctctgaccctcctcatctcatgcttccttccaagaactttctggaagagatgctggctttggagatgatatagggttttctcttcagaccacctgttctgcctagcaaaaagggcctaccttggccgggcacggtggctcacgcttgtaaccccagccctttgggaggctgagacggtggatggcttaagcccaggagttcgaaactagcgtgggcaacttggcgaaaccccatctctgcaaaaa

SEQ ID NO: 385975 - DNA, 304 bp, Homo sapiens
attttacttgggaggacaaattataagtaattgtagatagtgagatgatgaactttttttctaacacctacagcttgctggccttctatatttttaatccttagaatctatttttcttgctttgtgttatttcattatacatcagtgcccttctttggttatttggttattattctgtccatagactctcaagaggttttactgtaattttacctaactctgcagttggagtcattatctctttacttggttaaatattgagttagatgactttcatactaggggtgaaatatatatttctgac

SEQ ID NO: 385976 - DNA, 672 bp, Homo sapiens
tacaccttatgaaactggtagctttcactttctgtctcttggaacactctctctggaaacacttagtcactatgtaagaagttctactaccctaaagccaccctactagagaggccatgtgtagacactccagacaacaagcccagctgaaccccactttctagccagtggcagtcatgtgaggaaagccatcctgaccctcctgacaagccgacccaccagctgaaaaccattgagtgtcctcagtcaatttgaaatggagcggaagaatcacccagcagaggcatgcccaaatgcccaagcaacaaggtcctgatataataaaatgattgttatttttagccactaagttttggagtaatttgctatgctgcagtagataataagaacagaatttgatacctggaagtggagtgctgccataactatctaaaacatgtggccatggttttggaaccagacaatgagcaaacgctgcaaagatcttgaggacactgttaatgagaatagaaaaacctgaaggagacttctagtgaatacttagaggaagatactacaggaattactattggaggctggagaaaaagtgaccctggttatgaagtggcagaaattttgacaatactgttgcctgttgtgatctagacaatagaatatatacctaatgaactg

SEQ ID NO: 385977 - DNA, 400 bp, Homo sapiens
gaaggagcactgggaaaggttgtctgagaagctgcgagatctcaagagacggtctctccttcgtcattcctcagcccttgagcccctcatccttcacccaacaggagtatggaagcttattctctgtattatggacactagacacagttggaagtctgatcgtcatacgcaaaacagaaagaataagtgatcttatgctcagcaaatcccggctgcagagccctccctgacctttccactcaggtccaggacaccaacagccagactctgacccttccagataagatattggaaatggcttcttcataaaggctaaatttatgcttgcccctcaagattgcaaaattaagcaacatatcacttaaggacacatatgtaggtgatataaccaaaagaaaaa

SEQ ID NO: 385978 - DNA, 277 bp, Homo sapiens
ttagaaccttacatctaaatcaaagcagcaagcaaaaacttggcccctgttgtcggaatgccagggaagccatgtgactcaccagtgtacggttttctagaaaagacagaagcagttattacagaatgttaggctgcgttctggtattttgaaagtataacaacaactctgccacgcctatagtgacataagcattggtatgcccctttgtttcagaaacacacttctgtatttcacctcattgggacaatccaaccccatatcatgtttcatcacg

SEQ ID NO: 385979 - DNA, 228 bp, Homo sapiens
ctgacttcaagtctgcgccctcattttacaccagtggttttcattcattggctcagaatccacaggggaggcagatttagggtgaagcccagagtcactgccaggaaatgagcattgtgcgatgtgaaacaataacacttctcacacttacgtgtactattggtttgaattatatgtgacatgaagtaaaaatttatttaaaagcattactgattcagtaatgattca

SEQ ID NO: 385980 - DNA, 338 bp, Homo sapiens
actaatggaatagatatatatatataaagagtttattaaggagtattaaatcacacaatcgtatataaaaaaagtttattaaggagcattaaatcacacaatcatatataaagagagtttattaaggagtattaaactcacacaaaggtcccacaataagccatctacaaactgaggagcaaggaagccagttcaagtcccaaagctgaagaacttgaagtctgatgtttgaggacaggaagcatccagcacgggagaaagatgtaggctgggaggctaagcctgtctagccttttcacgttttcctgcctgctttatatcctggccaagcaaacagt

SEQ ID NO: 385981 - DNA, 313 bp, Homo sapiens
tgacaaggaataaacacaggcaaagcaatattatctctagttgggaaaacttcatagtgcatttttcagatgccaagcttgaatgaattcaaatagtgttcatagttttaagccttcatagaactagttccttttgatactaagaagatcctgaatggctttcttaagaaaaatgtatttaggccgggcgcgatggctcacacctgtaatcccaacactttgggaagccaaggcaggcagatcatctgaggttgggagttcaagaccagcctagccaacatggtgaaaccccatttctactaaaaatgcgaaa

SEQ ID NO: 385982 - DNA, 230 bp, Homo sapiens
aaacagaaggctcctttttctttgtccctcatccaagaggtattccatatcctgaattttgtgtttatcattcatttgcatttccatgtttgatttcttaaaaaatgtatttttaatgtttttgaaattttttttaccaacaaaatgattacatgtattcttttacaacatgcgtttttttgtttgtcattatgttcctgagatttatccatgtttcattgtagctctgg

SEQ ID NO: 385983 - DNA, 293 bp, Homo sapiens
ttctaatactgcaatcgttaaggtcaataatgatttagatttaaccagcttacaggttttactagcttctttgttttccattgtttcatatgtttgaaatttgacagggcaaagagacctcaagtagtgacaagataaactacctgaatataaggaagaggaggacaaagaccttgagagagaagagggcctgcagtgttcaaaaaagagcaagaaagtcagtcagaaagaaaggctaaagtggaatagtgaggtaaaatgtagtagaaagtgaagttgcagaagtaacaata

SEQ ID NO: 385984 - DNA, 653 bp, Homo sapiens
caggtgcccgccaccatgcccagctaatttttgtatttatagtggaggcagggtttcaccatgttggccaggctggtctcgaacttctgacctcagatgatccacccaccttgggctcccagagtgccgggattacagccatgagccaccgcgtctggccaaacattcatatattttatataacattggcaactgtcctgtttgtagtgttcttgcttcacatatggatacacctggtgtcagtttttacaaaaaccaagtgagttttggtgcgtatgccaggagggacaccccagaatgttaactgtcatgatcactggctggtagatgctgtgatttttgtagtgttttcatccttcgtgcctggttgacttatctgtctcctgagtgtatccagaattactgtcctttattttttattacacagatgtatgcatgtgcactgtttaaaaaaaaagatgagaacacatcaaaaaaaattttaattaaaaaaaagaaaaagagagatctatacatacagatcccagctgtccttctaatctttttctgaggcgggagaattgcttgaacccgggagcgcgggttgcagtgagctgagatcgcgccactgcactccagcctgggagacagagccagaaccgtctcaaaaaaaa

SEQ ID NO: 385985 - DNA, 293 bp, Homo sapiens
cgtcgaccgaggaactaactgcaccctggtcctcgtgtttgagttcaaagatggagcgagggtggatatggtgggaaggggcacacgggttctcacgcaacaacggaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385986 - DNA, 641 bp, Homo sapiens
tgcctggagctggctaggctgggcagaggaccacagagggaagatggacgggaagcttgaccttctgggtccaaggatgatgcctatgggagaggagggaggctcagcaaaccctccattttgtccactaccttcccctttctcattccccagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcgtgagtgacctgtcctcagccctgaggctgacctgggaactgcccctctttctgccccagggatcctgttctgtagcatagacccctgaggaaaggcagggcccagagggaggtttctaggtaccactggcctccaagagccctgaggtcccacaccctggcacaaagcgcagccctgacagccatgtctccctgtgcggggaggcgggggcacatgcggtcacttacccatgaagatcctgtgccacccaggccttgctgccctcttctgcttcttccagcatctctccctctcctttgcttgattctcttgtcttatcttgtac

SEQ ID NO: 385987 - DNA, 3363 bp, Homo sapiens
tgcctggagctggctaggctgggcagaggaccacagagggaagatggacgggaagcttgaccttctgggtccaaggatgatgcctatgggagaggagggaggctcagcaaaccctccattttgtccactaccttcccctttctcattccccagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385988 - DNA, 3851 bp, Homo sapiens
cgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtaagtgcctgcagcccagcaggctcaggggaaggggtgcacgtggctggtgggtcatgggcagtgggctccacccagggcctgagtcctgtccacaccccaggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385989 - DNA, 2220 bp, Homo sapiens
acgcgaaggcagccacaggacactgacgagcggagagcccggcaacgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385990 - DNA, 2166 bp, Homo sapiens
gataaaggatccagtcatgaactattagaaagtggggtcgcctgttacgtaacaggcctcttgggggtggctctgggaggcatacaagccgggtggccatgggtgatggccctggctgcccatgcccgcttctcatccccgtgtctggctgtgcaggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385991 - DNA, 2920 bp, Homo sapiens
caggtgcccgccaccatgcccagctaatttttgtatttatagtggaggcagggtttcaccatgttggccaggctggtctcgaacttctgacctcagatgatccacccaccttgggctcccagagtgccgggattacagccatgagccaccgcgtctggccaaacattcatatattttatataacattggcaactgtcctgtttgtagtgttcttgcttcacatatggatacacctggtgtcagtttttacaaaaaccaagtgagttttggtgcgtatgccaggagggacaccccagaatgttaactgtcatgatcactggctggtagatgctgtgatttttgtagtgttttcatccttcgtgcctggttgacttatctgtctcctgagtgtatccagaattactgtcctttattttttattacacagatgtatgcatgtgcactgtttaaaaaaaaagatgagaacacatcaaaaaaaattttaattaaaaaaaagaaaaagagagatctatacatacagatcccagctgtccttctaatctttttctgagggtacatactattttttattattattttttgagacagggtctctctgtgttgctcaggctggagtgtagtggtgtgattacagctcactgcagccttggcctcctgggctcaagcaatcgatcctccaacctcagcctcctgagcaggtggaaccacaggcgtgcgccaccatgcctggctaatttttctattttttgtagagatggggtctcgctatgttgcccaggttgtcttgaattcctgggctcaagcgatctaccggccttggcctcccaaagtgctgggattacaggcgtgggccaccatgcctggccactgagggtacatactgtttatgtaattaagggaagtgttatcttagctttgacttgaaataatgtgtagacagaggagatgctgactcctgtgggtggggaatcagctcaggaaaggcccttgcccaggcccaagtctgcagtgaggggtgagggaatgtgagctcaggggacttcctgggccaatcccagaattctctctggccctcaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385992 - DNA, 2759 bp, Homo sapiens
cgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385993 - DNA, 1143 bp, Homo sapiens
taggatcccctgcctgctgcgtagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385994 - DNA, 1125 bp, Homo sapiens
ggtccgccttggctcggagatccgtgactctgtggtgtgagagctgacccggggccgggggcacactggggataccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385995 - DNA, 433 bp, Homo sapiens
tgaccccttctgtcccacacacctcacctgcctgcagagttgccttctcctgcacgcctctctctttctcaccaagcctgctcctcattccctggagtgcccctgagcccatgtgtccaccctcctgcagaacatggagaacttcaccctggcaagggacgagaaggggaatgtcctcctggaagatggcaagggccgttgtcccttcgacccgaatttcaagtccactgccctggtggttggtgagtgttgagggcaggatggcttcattgaggttccatgtaggggcacacagggctagagggctagctttggacaggctgagtccatgccatgcttatttccaaggggacagaatggccaggggcttgccttgggtttggtttttccaagttccagcttccttctctgcccaccacaggcaaaacgggca

SEQ ID NO: 385996 - DNA, 3768 bp, Homo sapiens
gctctgcccaagccgaggctgcggggccggcgccggcgggaggactgcggtgccccgcggaggggctgagtttgccagggcccacttgaccctgtttcccacctcccgccccccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385997 - DNA, 3748 bp, Homo sapiens
cgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385998 - DNA, 3643 bp, Homo sapiens
agatggagtctcgctctgtcgcccaggctggagtgcagtggcacgatctcggctcactgcaagctctgcctcctgggttcacgccattctcctgcctcagcctcccgagtagctgggactacaggtgcccgccaccacgcctggctaattttttctatttttcggtagagaggggggtttcaccgtgttagccaggatggtcttgatctcctgacctcgtgatccacccgcctcggcctcccagagtgctgggattacaggtgtgagccaccacgcccggccaggctcacatcattttctaagcctcacctcctccgccaggtgggtctgataatgtgtcccgcgtcgggtcactgtgaggcagtgtggcactgtgtctgggtgaggcctctcctgaggccgactgtccaggttcaaacccttcggcaccgtgtcctggctgaggaggacggcgtccctgacacctgaccccttctgtcccacacacctcacctgcctgcagagttgccttctcctgcacgcctctctctttctcaccaagcctgctcctcattccctggagtgcccctgagcccatgtgtccaccctcctgcagaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 385999 - DNA, 3778 bp, Homo sapiens
cgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggtgagcaggccaacgaggaatcctggcagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 386000 - DNA, 2103 bp, Homo sapiens
acggcagtactctaacggtttaaggtagcgaggctgggtggcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccagaattctctctggccctcaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 386001 - DNA, 3663 bp, Homo sapiens
cgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctctcacgtcgacgcggccgcgaatttagtagtagtagttggcggccgc

SEQ ID NO: 386002 - DNA, 1323 bp, Homo sapiens
gtcatgtccctgtttgccagctggcattccatcgcgtagcagggggaatgtgccagcgtgcaccccaagacctgccctgtggtgctgccccctgagacccgcccactcaacggcctagggccccctagcaccccgctcgatcaccgagggtaccagtccctgtcagacagccccccgggggcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 386003 - DNA, 1933 bp, Homo sapiens
cgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtaagtgcctgcagcccagcaggctcaggggaaggggtgcacgtggctggtgggtcatgggcagtgggctccacccagggcctgagtcctgtccacaccccaggtgacggccggctccacaaggcagtgagcgtgggcccccgggtgcacatcattgaggagctgcagatcttctcatcgggacagcccgtgcagaatctgctcctggacacccacagggtgagcaggccaacgaggaatcctggcagggtacttggggggtgccctccattagcaccaagcagtccccacccagcttctcctcccttgcc

SEQ ID NO: 386004 - DNA, 454 bp, Homo sapiens
tcggaaaactgagttcaaatatagggtctgggacttctcaggtgatattttatcttaaattagaatctgcatgaggtagggtggggccactcatgcctataatctcagcactttgagaggccgaggcaggagcgtcccttgagaccaggagttcgagaccagcctgagcaacatagcaagaccttctctctatttttaaaaaactaaaattggatttaaataaagaatctgcatgaactttcttgtcacttattcttacatattatttgccagtgtgcgatacttaataaccaagtaagacacttgaaatgagtcttttaaggctacaacttaggtaacattttataaatattactgctacatacataatacagtaactttttttagcctcacaataataccttgtacaatttataactgctaaagggcctatagaaggctacccacctatgta

SEQ ID NO: 386005 - DNA, 3347 bp, Homo sapiens
gaattccgaagacgcaaaagcagaaacccctgataaaaccatcagacttcatgagacttattcaccaccatgagaacagtatgggggaaaccaccccagtgattcaattttctcccaccagttgcctcccacaacatgtggcaattatgggagttcaattaaagatgagatttggatggggacacagagccaaaccatatcaagtacaaagaaaagagtctcataagatgcaagtgaggaagagttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaatttttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaaaaaaggaattc

SEQ ID NO: 386006 - DNA, 3592 bp, Homo sapiens
aaaagcagcaactagggagctggtgaagaaggatgtctcagcagtgtttactaggcctccaacactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaacttttttttatattttagaaatgattctatatacaaccatacatgcatttctgtattggtcggcttatctggatgctattttttctattctctatgctttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaatttttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaaaaaaggaattc

SEQ ID NO: 386007 - DNA, 3328 bp, Homo sapiens
ctgcagggggggggggggggggggggggggggggggggcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaatttttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaaaaaaggaattc

SEQ ID NO: 386008 - DNA, 3496 bp, Homo sapiens
aaaagcagcaactagggagctggtgaagaaggatgtctcagcagtgtttactaggcctccaacactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactttttgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaatttttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataattttaaaaaaaaggaattc

SEQ ID NO: 386009 - DNA, 246 bp, Homo sapiens
cccccccagaacattatgtttaaaacagtcctcttctgtaattaacccattgccccctccgcagaacattatgtttaaaacagtcctcttctgtaattaacccattgccccccccagaacattatgtttaaaacagtcctcttctgtaattaacccattgccccccccagaacattatgtttaaaacagtcctcttctgtaattaacccattgcccccccaaataaatttctctcctgctaaatca

SEQ ID NO: 386010 - DNA, 402 bp, Homo sapiens
catacagatctgacttttgcccagagtgtcaaaaataaaatcaaggtaggatcagagaacagtggggagctgaaggggcagaaggaaagaaggaactctgaataaaacttcaccccacaatccagtctattctgttcatgtgttgagcacagctatggattagtgctggaataagcaggggaatatgaagatgaatgggtcttggagtttctccacccaggggagacaagcacatacatgcataaccctgacacagggcagactatggtctgtgctaagagaagagtgtaattattcttccccaaactgagtccggagcagacgggaggtggtgtggtaagaaacagggttgaacactggggagagggatttttgggacctggagcttgggcaattcctata

SEQ ID NO: 386011 - DNA, 641 bp, Homo sapiens
aaaaaaaaaacaatacaaaaaaaagaaaggaagagactgtggaacggtgcagagccagaaggagtttgtgacttttcatcttcaaattgtccaaatgaggctctcatgtctagtgattattaccattactgcagaactctgtgtgccactgatgctctgtgcccacggagaacaggcacagctgccaaggggtgtgtgtgtgttggggaccggcacgtctcctgcttggtctcctgtcttgctcggtaggctgccattcccgcattaacagccaacaatgcctgaagcgtagccttcatggagagtccacacgtctaggcaggccagagatttgagttcttgagaataaagccactgggccaggaactcacctttcaaaccctggtagagcattaaaatttccttgcaagaccagccaatgaataatggtaatcaatcaaatacaaaataactttcaaatagcattgtgctttatagcacacaaagcccttatttaaccttcaagaaaaccctgaggagtgggttttcaaaattattatattagtatccctattatacaggtgaagacaccaagagtagaaagattaagtgacaagcctggggtagcacatagaaggcacatggctcagtaaatattgatg

SEQ ID NO: 386012 - DNA, 163 bp, Homo sapiens
ataatccagagtgacaataggttggcaaagtggttacgttggatgcatattgaaaagattatttcatattttgagacagcatgaaggcattacagctttttagtggtgtgccaatttctcggtggaaagtggaattctcttctcagcccagtcctctccaagc

SEQ ID NO: 386013 - DNA, 360 bp, Homo sapiens
tcagttttgtgaatgggaattttatgtaactcaaaactgcatactagaaaatttcctacgtacattttaaaaagatattgtgactgcctttaaaattattttaattgattcaatttagaagacatttattgattatctgctctgttcaagcaattgttcaggccatggggatgaatatgggaggaacatacctgtgtatgtggaggttgttttttggtaggagattcaatcagtaacaaatattgaaagaaacagcatcaggttctttctaattatcatgctatcacaattagaaagcttacaaagtgtcattagcccttacaatatgtctgatttttttagccccaaacacaaccgtgt

SEQ ID NO: 386014 - DNA, 411 bp, Homo sapiens
agatgctatccctgcctttgatgagtttaaagtctagaggagaaggtgaacagaggcagcatgaggatctataagaaggtatggagtacagtagaaagagcagtaaactcagagccaagaagcctcagttctaactcagtttcctcctgttttagcagtctaagatttggcaagccatgttctctctctgggctttagtcttccatttataaaacaaatggactgaataagatgatatttaaggtccttttcagctacaagagtccatgttccaagagaagataaaaattgcagcagcagcagcagcaatattcactgaagacttagcatgtgccagaatcttgctaggaaccatttacttaagattccattttgtatgaaatggcattaccggcattactacatcacttt

SEQ ID NO: 386015 - DNA, 1650 bp, Homo sapiens
  misc_feature (1)..(1): n is a, c, g, or t
  misc_feature (573)..(573): n is a, c, g, or t
  misc_feature (702)..(702): n is a, c, g, or t
  misc_feature (1284)..(1284): n is a, c, g, or t
  misc_feature (1650)..(1650): n is a, c, g, or t
ngcagtttgatctcagactgctgtgctagcaatcagcgagactccatgggcgtaggaccctcggagccaggtgcgggatgtaatctcgtggtgcgccgttttttaagcccgtcggaaaagcgcaatattcgggtgggagtgacccgattttccaggtagagacacttttgacttgatctctgcagtcctcaacatggtcgaagtctgaaatcaagtgtgagcagggccacatgggcccattctgaagacccgaaggagagtccccctttccctcttccagcgtctggcagtcctaggccttctttggttgacggcagcctcacttccatctgtgcctgtgactcacatagccctcttctcaaagtctctgactttctcttctcttaaaagaacacctcggctgggtgtggtggcacacgcctgtaatcccagcactttgggagccccaggcaggtgatctgcctgcctcggcctcccaaagtgctaggattataggcatgagccacagcatggggcccagtttcaatcttttaccaatgaaaacctgaacacaaaacaataattcttaaccantcatgatgaaacacagtaacttttttttttaataaaaggaagaagaaagtgttgaaaattgacatctatgtttacatatcacagcaacacaaagtgccagcaaaaaaaaaaaagtggaaaaatgaaagnatcttggccccatgagttttgctctgcttcccactgtcatttattcagtacatgtgtcactagatccaggacttgctctagaagttggaggaagtcaatggcactgtgagaaacgtgaattaccaagggactctgtcatgtccttcgttactcatgtgacttccttacatgaaaggaaaatagatcctggggcctccaaatcactcagctaaagggaaaagtcaagctggatctgcttagggcaaacctgcctcccatttattcaaagtcatcccactcttcactgagataaatgcatatctgatggcctcctttggaaaggctcatcagaaactcagaagaatgcaaccatttgtctcttatctacctatgacctggaatttcagtattaaaccaatgtttatcttgcatatattgattgatgtctcatatctctgtagagactacatgaaaattttgttgttgaaataattcgttgtactgagcttcaattgaaatgcttaaataccttgaaaacatttccatttttgcctttactcaaatcaggtggtggctactttctaatgaatgcaaatcccagtntgtgaaaagtgtgggttaggacaataaaaggggaggtgacaccattttaatggtttctcagaagctgtgctccaatgtccttgggcacatgtcatcagtacctcctgaggttatgtcacaggtgcatgtccttaactttggcaaaataaacttcctaaattaactgagatctgtctcagatattcaggcttcagagctatgccagctaaccccttatgctgaaaacgaggacttagaaggaaagggcaagagagccagacttgctttttccttttttttttttttaaagtcttttcttattcatcaataagccaaaagtagaggttgttagtagaaaatgtgtgcaccaagaagtgaaataaagan

SEQ ID NO: 386016 - DNA, 714 bp, Homo sapiens
tgtggttagtgcaataccataaaccttgaataacaccatgggacccatatgaagggccactaggaatgctggaagtgctcccaagaagcagagatcagtcatgactttacaagaagaagttgaattgctcgagtcttgctctgtcatccaggctggagtgcaatgtcgccagctcggctcactgcaacctccacctcccaggttcaaacgattctcctgcctcagcctcccgagtagccgggactacaggtagagacacttttgacttgatctctgcagtcctcaacatgccatcttctatcccaagggcagccatcttctatcccaagggcagccatcttctatcctgagggaagctggcctgaggatgaagccagaatatggagaagaggagaaggagatggctgagaagcagaacggaaacctgaactgcatttttcttagagcaagaattacatcaattcttcaagccaagttgagcactgttggtttctgctacttggaactgaataaactctgacagatactgtacagggaacagtacttggggagctccacttcatctgaggccttcgtgagtggcttgtgtcacattcctggctgttcaggcatcagtcctggtttcctggtgagctctctgctgactccacccagagctcccttgcttccgtctctgcagcagctacctccgttctcacacatggcttcttctga

SEQ ID NO: 386017 - DNA, 288 bp, Homo sapiens
tttttaggtcccgtcattttttttaaaatggaaaacgtaaggagattgagagagcaatggtgctttaattcttttgttggttccattgtagttcaagcattttgctctacttctgagcatgactcactccagttcatcttaagtactagcagtagaattttacatagattataccaattttaaattattgcttaattatttcaattaagacatttccaaattctcaattatataaatgatgctatgctgaacatctttgtagcaaaatctttgttcatatcaatgata

SEQ ID NO: 386018 - DNA, 504 bp, Homo sapiens
gcatgcctcactacaccatccccaccctttctggaatttaggcaaaactgacaagcattaacattaaaatggagatcataagactgataagacagattctttgtaacaataagataccaaactataaacaagaccactgaccataggctaattctggctagtttacaaaaagtacacatttgcatgcctttatgtcctaaaaagaccttttgatgtctagggcctaattataatacattatatgttaagtccccacacaaaaataaacatgagtcatatgttacatacatatttgttccatacacatgtgtcaagactgccttcataaacatttatgacctctcctgtatgtcttaaccaaaagatgtgggaaatataaactaaaaaaaaactgttaaatttgtgtattgagtccacctgtccatcatatccccacaagaactctgggacacaattgatagtggggactgtgcatggataaattaagtaattaagactgaatgc

SEQ ID NO: 386019 - DNA, 1096 bp, Homo sapiens
gtaggagcggggccaacggtcgccctggctgggtcgccctgactgtccgacgcgccctggctcagccccagcagaggaaaaaaataacagctgagggaggggtttagatgctcctccaagggcagagggcagcgctggaagagctgtgagccggagaatcccacactgagcatgtacggaaagacaacgctgccgtgggacacccaccagactgagaatgccaatgcttagcaaagaataagttcacttcaactttttctactctggtatcaggagaacggactgtgctacaaaaacaatctggtactccttacaaagctgaacatgtgtgctcctcacaacccagcaattctacttttaatacatttatattctagaaaaactcaccaggatgcaccaaacacagacaacgctgttcacagaagcaccgttcaaagcggcaggaatgtggaagccacccacctgagcgttcattcaacagcagcgtggaccaagggactgtggcgcacagaactgcatgtttaaaacccttgggcagatgggttttggaattcagaattcttcaatgtacaacgattatttggcacaatttaccatgtaacagcctcactggggtttgggggcactccccatcatcagacgttatttcttcactgaaatgtgttaggtatctatactaagtggtagaggctattaaactttacctggtgaggttttggccaccaaataggttaaaaacaaaaccaaaaactgtggtttcagagatgtttagatttttagcattgctgagaagggactgtggtcatgtattcacacaagagaatttcataaagcagttaaaataaatgaacatgacacaaagtcacctggatgactctcataaaacaatgctgaatgaaaaaagagagttgcggccgggcgcggtggctcacgcctgtaatcccagcactttgggaggccgaggcgggcggatcacaaggtcaggagatccagaccatcctggctaacacggtgaaaccccgtctctactaaaaatacaaaaaattagccgtgctcggtggcgggcgcctgtagtcccagctactccagaggctga

SEQ ID NO: 386020 - DNA, 496 bp, Homo sapiens
caatattttcttttactagactgacagacatataggagcagaaaattgcattaaagaagaatttcagtttttctcttaagagagttgtaataaacagaaaaattatggaccctccaaaaatacaaaatgaaacacatccttttcattcataatttgatcaactgacacctattttgtgattcttacaaaaattcaatcttgataatgtgtcttcctaagatctcaataaatctttattttagatggttttaaaagagcttggtaaatatttaattgataaaggtgtgattgaggattactgtttaagttttagattttttttttttttttgccatcgctactttaaaatgtaattttaggtattgactacatgacttatagcataacacatcttctttttgatttttatgtaacatgcaggctaatagaaaattttcctttgaaaataatttacctcttttttcctgctgcttggctgtccattcagtcctataac

SEQ ID NO: 386021 - DNA, 594 bp, Homo sapiens
gttcagtagaatcatggaatcactgcaccaggtatttcctgaagggccttcagaatcctattgccccacaatagaaagggctttcagggcaaagaccatattcattcaacacatgtatattgagtatacctgctgtctacatggcactgcactaggtcctgaacagcagtgagtaaaatggcccctgtccttattggtgttcctttataggtatgggagaagacaataaacagataagcaaataaatacagctgacccctgaacaacacagaggttagcaccaatcccccatgcaatcaaaaatatacatatggtcaggcacagtggctcacacctgtaatcccagcactttgggaggccgaagtggatggatcacttgaggtcaggagttcaagacaagcctggccaacatggtgataccccatctctactaaaaatacaaaacttagccgggcgtggtggcccacgtctacaatcccagctacccgagaggctgaggcaggagacttgcatgaacccgggaggcagaggtttcagtgagccaagatcgcggcactgcactccagcctgggtgatagagcgagactcggtctc

SEQ ID NO: 386022 - DNA, 413 bp, Homo sapiens
tgaagatctctgaacatatacctgaatttggctatgccttctgaaattgtgatgaaaacatagatagaaagcatcataaatgcatgcccatctgcaactgtttgactataaagctgtcagtgaagtagaatatcggaaatattttcatagaaatgttcgttggaattaatattttctttctggtggtggcaacaagaggacttgtcttaggaatgctgggaaacgggctcattggactggtaaactgcattgagtgggccaagagttggaaggtctcatcagctgatttcatcctcaccagcttggctatagtcagaatcattcgactgtatttaatactatttgattcatttataatggtattgtcccctcatctatataccatccgtaaactagtaaaactgtttactatt

SEQ ID NO: 386023 - DNA, 402 bp, Homo sapiens
tttatgtaaagaactgtacagtagaaatgaagaaattgtcagttaatagcctcttgtagattctattttaagaaattaactgatcatatgtaataagtaagggaacccaggtggccaccagtcttcacctaactcttagtgtagtaatgtatctaacaggatctcagattggtgtgctccactccccctcttgaatgccagcaatgatccaagtgtgctacaaagcaacagcaccctccaatgtcatgaggctatgacaggatttcttcagttggatagaaacaagcctctgaaacttcccttcagtgctttccaaagtctgactttttttcctcttttcgaggtccttattcctaatccttaaaacattaatactctctaggttctctcctaacatagacc

SEQ ID NO: 386024 - DNA, 294 bp, Homo sapiens
gataatttgcagggtttttttgttttgttttgctatgttagtaattttcgttcaggtataaataggtgagatataaaggcactgtaaaaagtaatataccattgtctttgcttgttaaaggaactctggctctcataaaaactatttcacatcaagagggccccctaaacaattttcttctttgacattacaaacttctttacttcacagttgtgatttcttccttgagctgtaatgttttctctctatgcctagaacattatgcaaaaacagacatcataggtaaccccattt

SEQ ID NO: 386025 - DNA, 763 bp, Homo sapiens
tctatggatttttgtatatttatgtttacctagccaccttatcaaggtacatattagtaagaggttgctcaagtaagcattcctgggtattcccaagaggatacttgtgaaaaatgtgtagtccctacctactcaaacagaatgcagaagtatgtttgggaaaaaggacagtgaggtgccttcattactgtatttttaacaaattttccagatgattttgatgctcatccatacttaggaaccagtaacttagaccactttagagagcttaaagcagactacattttcacaatatacatgaagttttaaatgacttcctacattgaaaacgtcagaagctgccatttatataacctcattagagacaaaaattagtctagcacaaaagctataaaaaagttccaaaagtttaattatattttaggagagttaacaggaaacagcgatgagcaataagtttccataaaacatatttacataaaatatcaccttcagctatatactctgaaatccctaaaaagtatagagtgtatcctatgaaaccaagaataacctctctgactccaaaaactccttttaacatgctcttctgtagaacaagcataatgaactctcagcattactccataaaaacaagagacagactaatgtgaaaaccattaacagctattattttgatttaatatggcatatagaaccacaaatcaatcttaagatgtctcaacatactttactaatatatgaatataagccaacattccat

SEQ ID NO: 386026 - DNA, 290 bp, Homo sapiens
aaagaaaggtcagctcccacggtgtacgtcgggtccccatgcccgtgggcccctgcaggcagctgacacggcgttggttgacatgacacacttatgctgtaggaaaagaactctgtccccacccccaccccacgggggacagatgccgcagtggggttggtcacgtgctgctcaatcacatgccctgacgcagattaaaaggaacacacagagtctgaagaggaaaggtgttcccacgccaggtgacaagccagctctggctgtgaggccttgcctgcatctcagcgtgt

SEQ ID NO: 386027 - DNA, 289 bp, Homo sapiens
aaagtattgaaaggcagagtaagaataaagcgggaaaagtggatttggtgacataaaaattgtctcaagtgaaacttaatgacactcaaaaaataggctttctatcaccattctgggccccgaaattctcatcaaatgtaatatccacctggatgcatcaaagatcattgacttctcagtccaaatgtctcttttccaccacttcaggcatccctcttaggcttgtcagcccagtggctgtaaatcactcctaaaatctcgatttcaagtatttgagaaccattttcaa

SEQ ID NO: 386028 - DNA, 428 bp, Homo sapiens
acatactgttcacaacaactctaagagatagatgtatcccatctcctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaacttactgaagttgagtggtagataagaggagtgtttagcaggctggttctagacctctgcgtccatcttggttagaaagaaatagctccagggctcagccaggtgcagtggctcacacctgtaatcgtaacactttgggaggccgaggtgattggatcatttgaggtcaggagtttgagaccagcctgaccaacgtcgtgaaaccctgtctctaccaaaaatacaaaatt

SEQ ID NO: 386029 - DNA, 1558 bp, Homo sapiens
  misc_feature (815)..(815): n is a, c, g, or t
gacctgaactgtagctgcctggtccaagcagacaggattccgtcagttgtgatagagttctagattggcaatgcagttacattgtttcttctttgaaaataaagttctagacatataaaacaggaaaacaaaaaaaaaacaaaaaaaaacaaaaaaaaaaaaaaaacaaaaaggggggcagccgcccacaagaattactcccctccaaggagggcccacagaactcgcgcttcaaccagcgttcttgcgtgcgtcacaaggggggccccctcagaggagacggcgctatatataataacactcacagcgcgacaggcaggccccgggccggttatacaacacagccgctctgctgagaccgtgcggaacacaacaagcgcggcgcacaagcgcgggaagccacactctggagaaagaaaaagcgaacacaccctgatcatactacatgaagcgggagggacggtgacacacccacatacgggtggggacgacaaccaacacatcacacacaacacaagacggagagaaggtactattcaaacacgccccatcacagagggggcagtataaacctactagtttataccaagaaaccctgtacaaaagagaaggtagtctcatatacacgcggcgtggtggtagtcacacacacactacaagctgcagcggtacacaatatattctcgtcgcgacgcccccgccgtccttctagagaagacacatctctttcctgcgcagcgcatcacgcagcgggagaccaactagtcacagactatcttctgctgaacaccaaaacttctatttattccctcacncccacgcgcgtagagagctctcagagaaggagaaaaaaaaaagacggcagacccccagcacaagcgccgcacgccagacgcacgagccgcaccgcgaccccgccggaccctggcgcgaccagcgcccacgctgctgccacgcacgctgaccgacctgacgcccgcccgggcgcccaccgccagcgagcgcagcgcccgccaagggccggctgccacccgcacggccgcccgccagcagggacggcggggggagagggagctggaagctggggtggggagtgagagcgagcggcggcggggagggcgggaggggcgagaggcggacagggcggacgggcggggggcgcggaagaggatgtcgaggcgaggcggagagggacggggcacagaacgggccgagggcgaggcaggcgcacgaggagagcgggcagacaggaggggcgggggaagagggactggtagcgagcagagagacagtctgcggcggaaacggtggacgtcggagcagtcaggcgcgagacgcggagagaggcgggacgcggagcgaggcggaggagtggcggggcgcgagcgaagggaccgccgagcaagaacgcacaacagcggacgaagggtgagcaggggcacaggaagcgagcacggagacaaggacggagcggaggacagagcaagagccagtgaggaggagaggcgaacaagacgatacggcgaacacacagacactagcacgcccaacagcacgc

SEQ ID NO: 386030 - DNA, 221 bp, Homo sapiens
acatatatatggtgcttgcctgggcaacacagcaagacgtcatctctacaaaaagtaaaatcagctgggcatggtggcacactactgtagtagttccagctacctgggaagctcaggttggggagggtcgcttgagcccaggaggtcgaggttgcagtgagctgtgatcgtaccactgcactccagcctgggcaacagagtaagaccctgtctccaaaaaa

SEQ ID NO: 386031 - DNA, 291 bp, Homo sapiens
ataccctttcccccatacctcaccctatgcatgtctttatctgtatcctttctaatattctttctaataaaccagtaaacatgcttctctgagttctcctagatggtttagcaaattaatcaaatccaaagagagatttgggggaaccccagcttgaaaccaatggattgaggtattgcaaggtggttaaggtaggccctaatccaggatgattctagaggaaatctggacacagactcagagagaaaacaatatgaagacccggagagaagatggccatgtacaaggcaa

SEQ ID NO: 386032 - DNA, 402 bp, Homo sapiens
aatacctgctcctctgtggatctcaagctccatgatcctcaaactagaataacatcagctcctctccaggtctccagctgcagtatcctcaaacgagaacatcagcttctccctgagtcttcagcggcacgaccctcaaactagaacatcagctcttctccaggtctccagctgcaggacactcatactagaaaaataccagctccccctgggttctacagctgcacggccatcaaactaaagaaacaccagctgctctctgggtctccagctgcaggaccctcaaaccagaacatcagattctcccgggttctgcagctgcccaaccctcaaactaaagaaactcctgctcctcccagggtctatagctgcatgaccctcaaactaaaaaacaccagctcc

SEQ ID NO: 386033 - DNA, 308 bp, Homo sapiens
atttgtctgtaacaggctgaatcgccccactcccaaactcctggtcgtgatactggatatttgttatgccacttttagtttgcatgaggtatcttccaggaagtattagttattaacttgtgttctactaaactgtagatatttatttcctgttctggaagatttcttggagtgtccatctgtgcattcctggtgcctagtgtagtcttgctaatggaatagcacctttattggtgctacttaggggttggtagcttacaatcaatctacttggaacgtatccaaataaactggatatttttatacag

SEQ ID NO: 386034 - DNA, 350 bp, Homo sapiens
gcctgtggtcccagccacttgggaagctgaggcaggaggattgcctgagcctgggaggtcaaggctgtagagaggcatgatcataacactgcaccgcaacccaggcaacagaatgagtgagactgtctcagaaaataaaaacaaaagctggtagacccagtggacttaaattccacctctgctgcctactagttatgatttggggcaccactttaggcctataaacctgtttccttgtcctcacaacagagctatgggtacatatttcatactcatattcctaagttcctatgtatatctaaagtacccagcacaatgcctgccccagttagctttctaattccctggag

SEQ ID NO: 386035 - DNA, 653 bp, Homo sapiens
aaatatactttatggagttcttggcaaatagaaagtagtaggagctgaaaatattactataattatttaaggcaaaagaatataagtgaagaattttaagcaggagattaatatagatttaaaagttagaaaaactcctaggtagttgtgtagaggatacactggggaggagtgagagaggaagtgatggagaattgctaaaaagctagtcacagactgcaaaacaacattttggtcaacaatggaccacatagaagatgttggtcccatgagatcatagtggagcataaatagaaacctaataatatggtgcttgatgtgggcattgcagatcaagtatgggaaatgattgatatttaatgctgcttctgggatatttggttttccatgtgaaaaaatatgtatataaataaaaatatatatcatctaggtttgtgaaagtatagtctgtgatgtttgcacaaccacaaaattgcttaatgcgtttctcaaaatgtattcctgtccttgtgactcattactgtatgtgattaaactaggtgagatttgacggtcttctaaaccaaggacatgggagtaggttagagaaaggtgaatttttcagatagtaggagagagaatctgaatgaaagacttgctgactcacaggagtg

SEQ ID NO: 386036 - DNA, 542 bp, Homo sapiens
  misc_feature (405)..(405): n is a, c, g, or t
  misc_feature (419)..(419): n is a, c, g, or t
ctacgagactgtctcaaaaataaataaatatataaagtgcaggataaagtgatttcttaggactaattgtaggtcatctgccttccagttagagttatagaattaatcattgcctttctgtagttttgtcacctacttctattacaaaaatttgtttgccattcttttttctgaatgactccccttacctgaggaatgcagtctaataagctctttagcattttatactacagcctttactaaacagcccaatctatctttttgtcttcatctcctgaaattccttttcacatatactgtgcttcagccacagatacttgccatgtcttgaatataacatattctttcaaattgccttttctttgcatgaatccttctcctttccttggatttcttatttcttgncttctgctagcttnggtgtttgtttgctcttggttctctaattactttagttgtgatgttagtttgttaacgatatctttctagctttgggatgtgggcatttagtgctataagtttccctcttaacactgctttgc

SEQ ID NO: 386037 - DNA, 419 bp, Homo sapiens
ggctaatatccaacttattatagcactgtaaacaactacaaaagttaaataaaatatgtaaaagaactgataggacattgcatcaaggaagcccatttatattggcttttctgaaggcattttctaaaatagcacagggcagtaaaacccagacagaaagcataagtcttattaagcaaatgaggcagagatcctagtgctgggatctgaaggacagggtcccagagaaggaaccatagggaaagaactctaaaattctgctttaaaattccagttgggcgtggtgactcactcctataatcccagcactttgggaggctaaggtgggtggatcgcttgagcccaggaatttgaagctgcagtgagctatgattgcgccactgcactccagcctgggcaacagagcaagaccctgtctc

SEQ ID NO: 386038 - DNA, 301 bp, Homo sapiens
ggtgttccagcccctcctctcttccgccccctagtctcccacccttccctccccgtagtgaccaattcctatctcttccctctccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386039 - DNA, 2880 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctg

SEQ ID NO: 386040 - DNA, 2956 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggtgagtctgcagggtggcgggggggctccagccctgccgggggagtggtttctgacctgtctcggcgcccgcacaggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctg

SEQ ID NO: 386041 - DNA, 1591 bp, Homo sapiens
gtgtggagcgaggccttgttcccgcgttgagcccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaaccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctg

SEQ ID NO: 386042 - DNA, 2727 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcagccttcctgaacctgcctctctgaggataaagcaattcattttctcccaccctcggccctcttgtttttaaaataaacttttaaaaaggaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386043 - DNA, 2826 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagtattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctg

SEQ ID NO: 386044 - DNA, 2347 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgaggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386045 - DNA, 3109 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386046 - DNA, 2810 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgaggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctg

SEQ ID NO: 386047 - DNA, 1169 bp, Homo sapiens
gtgtggagcgaggccttgttcccgcgttgagccgccgccgccgccgccgcctcctcagcttcagcccccctcagcccccacccaccggccagtcggactacactaaggcctgggaagagtattacaaaaagatcggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctg

SEQ ID NO: 386048 - DNA, 3039 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgaggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386049 - DNA, 2378 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggccagcagccccagcagcccggagcgcccccacagcaggactacacgaaggcttgggaggagtactacaagaagcaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386050 - DNA, 2434 bp, Homo sapiens
gtgtggagcgaggccttgttcccgcgttgagccgccgccgccgccgccgcctcctcagcttcagcctccgcgccaggcccggccccgccgcgccatgtcggactacagccggcccgggcggggggtcggccgggggcccctctcagccacccggcggaggcggcccgggaatccgcaaggacgctttcgccgacgccgtgcagcgggcccgccagattgcagccaaaattggaggcgatgctgccacgacagtgaataacagcactcctgattttggttttgggggccaaaagagacagttggaagatggagatcaaccggagagcaagaagctggcttcccagggagactcaatcagttctcaacttggacccatccatcctcccccaaggacttcaatgacagaagagtacagggtcccagacggcatggtgggcctgatcattggcagaggaggtgaacaaattaacaaaatccaacaggattcaggctgcaaagtacagatttctccagacagcggtggcctacccgagcgcagtgtgtccttgacaggagccccagaagaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggaacgcgctggagtgaagatgatcttaattcaggacggatctcagaatacgaatgtggacaaacctctccgcatcattggggatccttacaaagtgcagcaagcctgtgagatggtgatggacatcctccgggaacgtgaccaaggcggctttggggaccggaatgagtacggatctcggattggcggaggcatcgatgtgccagtgcccaggcattctgttggcgtggtcattggccggagtggagagatgatcaagaagatccagaatgatgctggcgtgcggatacagttcaagcaagatgacgggacagggcccgagaagattgctcatataatggggcccccagacaggtgcgagcacgcagcccggatcatcaacgacctcctccagagcctcaggagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtgagtgtggccccctgcaccctatcccttgccccctcttccctgggccatcactgcaggccaccttcaccttctgcgtttctgcaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgagggtcctctctgcccagttggaccaggcccaggtggcccaggccctgctggcccaatggggcccttcaatcctgggcccttcaaccaggggccacccggggctcccccacatgccggggggccccctcctcaccagtacccaccccagggctggggcaatacctacccccagtggcagccgcctgctcctcatgacccaagcaaagcagctgcagcggccgcggaccccaacgccgcgtgggccgcctactactcacactactaccagcagcccccgggccccgtccccggccccgcaccggcccctgcggccccaccggctcagggtgaggccagcagccccagcagcccggagcgcccccacagcaggactacacgaaggcttgggaggagtactacaagaagcaagcgcaagtggccaccggagggggtccaggagctcccccaggctcccagccagactacagtgccgcctgggcggaatattacagacagcaggccgcttactacggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaaaaaaaaaaa

SEQ ID NO: 386051 - DNA, 2092 bp, Homo sapiens
  misc_feature (1524)..(1524): n is a, c, g, or t
caggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagcaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttaggagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctngaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaa

SEQ ID NO: 386052 - DNA, 464 bp, Homo sapiens
catttcacaagttaggaaaagaaagtggtggttccgaagctcggaatgatgggctcttttcctcctccacccccccaccttccatatcaggaaagaaataaaacgcacaatgagcctttatttcaggagagaagacttcaaaatacgtgccagtaatggacaatttgagcttttcactggaaatactcacaccgcaagctggaaagggattaaaaagccccacgtggttgatctgggtttatacttgcaacctccagttccccacgtatgttctttgcaaaggttggcctctagatggatgcaagtaagggaccctctggggctcgggctcggcgcctcgggcagggctgacgttgggagcgctatgagctgccgggcagggtcctcaccgggggcttcctctgcgggccagggctgccgggcgccaccgggacgcgagcgcgcacgcctcggcccggcggccg

SEQ ID NO: 386053 - DNA, 407 bp, Homo sapiens
actccatctgtgcaatctggaacctgcagcacagagctaaccagctgagctgtgtattagagtcagtgaggctcccatcaatggagttttatttccaggaaaatggaaatgaaggatgaagtcttcctgagggcctcttgctggtgatgttatctgctacacgcccaagaccaagaacagtccctggcccacggtggtggcatgcagtcattgtttgaagagtccctcaacaaaggaagagaagagctctgcacatctgggcatgcctggtgtgggaccttctccttttcctccccactctgccatctcacccttcacccccagccaatgcagagagagggccaggggtcagcagactcccatccacagaacggattttggtatgaccagggaactaggaatttctt

SEQ ID NO: 386054 - DNA, 624 bp, Homo sapiens
gatcaaaatgttgccttgggctgtgaaggtcaggggtttcactactctacagcttcatgtgggtcataccgcctgccatctatgattgtagaagcgggactggcttggtatgagctcctttactgctacagtcccatagcacagcccagggctttgttgctttgccaatgcaggtagtaaggagtgctccatggccgagagtgctgaatggggcttgagtttcctcattaggtcttcggtgggtttaccttgttcagagaatgcatttccacccagcctccaccctgtttttcacctattggtggttacaggttatactagcaaccagtccaggggtatatgggagacagacagaaaacctaaggcttgtctgtttctggtcttgagcttcctagctagtctacctttttttcttccagctttcagagtcctgttgttgattgatggataatttccagggaagttagttgtatttagagggagaagcagggaaatgccatctcgttctgaagggtgagggttaagagaatatggatacattcttttaaattttctcattatagataaatgttcatatacatatatactgtgtatgtatatatacacacatgcttatgttgtatc

SEQ ID NO: 386055 - DNA, 445 bp, Homo sapiens
gtcttaggtctgtcccttaattctgcagagtacctaatgcatttccaaaaaaatcattctctgcttaggttacagttttagggtctaaccctacatggtgtagagtgtaacaatacaattacattaattttgcaaaattgcatactttattatacaaaatggaatttttgtaaaacagctccacaaattgtcattatctacaagttaggcttttttttttaggataaacatacattggctgcaacaaactcatagttaagatctcacagtgtgattagggagacaagattcaaaatatacaactttaaagagcatttttcttttaatgtcctattatttgctttctgtactttatcatacctgtaaattcttgtctctgtaaaactcaataatctggtggtttcactgtaattctttcagtattaatatattgtggtctgcttgt

SEQ ID NO: 386056 - DNA, 183 bp, Homo sapiens
tgctgggattacaggcatgagtcactgcgcccagccttatgttgttttactgacttcatagctgtaatttttaatggctatgtaatatatcatcctgtagacacaaagcaattaacttaccataaaccataatataagacattagagctgttttgaattcttcaaaattataatggatgacca

SEQ ID NO: 386057 - DNA, 1374 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcaccaggaactctactggcagattggcattgaagagttcctcatcggcggccaggcctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttta

SEQ ID NO: 386058 - DNA, 1954 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcaccaggaactctactggcagattggcattgaagagttcctcatcggcggccaggcctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttctttaaaaaaaaaaaaaaaaaaaaaaaaaaaaaaaaaaaaaaaaaaaaaaaaaaaaaaaaaaaaaaaaaaaaaaaaaaaaagagggggggggcgcccaaaaaaacccccccgggggggcgcaccaccaaaaatcaaacacgcaccccccacagcttttatgggtcagacaacggggcgcccacatatgagcgagagacaggcgcaataataaacagacgaaggagagaggacgggcgcgggtataaataaagagcacgaagacgagggagaaaacaaagacgacataggagaatacttttgagaaagcagcccaccacctcgcggcgggggggggcggaccacaagaggcggggacaccacacacccaccgcaagaggaaatttaaacagcgccccccagcgagaggaaaacaaaacacacaacctcacccgaggcgggccataagagcgggggggcacacaaaacccgggactacgtcgttgcgtcctccgccgaccgacgagaacatggcgcccaaccgggggcacactggatcacaaccagaataatcacaaccgcggcgcgagcgctcccgacaaaaagga

SEQ ID NO: 386059 - DNA, 1078 bp, Homo sapiens
ttggccgctgatgggaggacaggtaggtgggctcgactcccacggtgcagtagccgttgttactgaggatataggaggaaggtggcagagggaactgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcaccaggaactctactggcagattggcattgaagagttcctcatcggcggccaggcctccggctggtgttctgagggttgccaggccatcgtggacacaggcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttta

SEQ ID NO: 386060 - DNA, 355 bp, Homo sapiens
  misc_feature (13)..(13): n is a, c, g, or t
catgattccaganctcagcagtatgtggagtccctctgcaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttta

SEQ ID NO: 386061 - DNA, 546 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctctcccctcttcctcttgaccctgcaccctcctagggcattgtatctgtctttccactctggattcagccttctttttctggactctggactttctctaataataaatagttcttctttaaaaaaagaaaaaaagcgacacataaaagacaacagaacgaatatacaaacaaaaaacaataaaaaaagaagggggcgggc

SEQ ID NO: 386062 - DNA, 611 bp, Homo sapiens
gagttcctgggtgacaggcgcgcagtagatctgcccggtgtacaggctgctatccacacccccaaagacaaccgctcgcccgctggagccctgctggttgctgaggtagacgctgaagacggggctggtgagggcgcacctctctgctcactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttcttta

SEQ ID NO: 386063 - DNA, 598 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccacaagcgcctggtaatcctctaga

SEQ ID NO: 386064 - DNA, 485 bp, Homo sapiens
tcctcaagtaccacttgagcaattaaccgtaaattatgttcagtatagctttgtattaagcatttttgctcttttataattagtagaaaattgttcatctgtgtgtgatatatatagtatcactcatctagatatctcagactctgaaataatataattgactaatttggaatttataagttaaatttataaggtttttaacaaatatatttgtaatggaattatttgacttttccaaataaattgcataaagatgtaaggattgcaacagtttatattaaaatttttttctggtttgcaatacttgggtggcctgatgaaaagaaattcttcaactttagtctctttcctgcattgtgttcataccactcatattttaaaagttgaccagtactttttgttcacttcttaaatgatgaaaaagaagccatcatgtaatttttttaaatcgtaagtattgtgcaaaaagcattaaaaaaaaaaaa

SEQ ID NO: 386065 - DNA, 448 bp, Homo sapiens
ataaaaatgctgtatgattttaactttaaaggaaaaaatctgtaagatgtggttaattaccaaaaggtgtttacctaaggagcacacagactttaataccccaaattaaactttatattatactcaaggagttatcagtggttgcttgctacactgagaagctgctttatgtgttttagactccctagaccatcaacagtctctttttgcccagcagtgccacataaacataatatacgaatgaaaacactgtgcttcttatgaaaatacacgttcaaaacaaattccccagcaggaatattgaaggtgaatgtggtagtaccctgacttaggttacagattttcaaatctgggctactcttcattaggctcacctgggagagctgttaaacatggcagattcccagtgttcccacagaggtctttgtttttcagggttcccaaggga

SEQ ID NO: 386066 - DNA, 400 bp, Homo sapiens
gcagcccccgcgctccccaataaaggatgcacccaccgagcccgaggactgaaacattgtttaggggaccccaggcactgaagggcgggttcctggagatggacatttggagtgcggtgccaggggcttgggaggattcccgcgtatacgtggtgtgaaagtcagtctttgaatgtagagcagatcaatgtggaatgaggactgaaaggtctgtcaactgaaaaaaaaaacaagaatgaatataaaaaatcacaaattaaataaaccatggtccatccatattaatagacattactcagtgattatacaatataagcttatgggagcaagggagttcctgaatatccttgctgactgtgccgaaatgcaagacctacctaccctctaactctgagccact

SEQ ID NO: 386067 - DNA, 769 bp, Homo sapiens
gggcattgatgcagtaatgcccttcttcacgttgatgtgttctgtttacctcccagaggcaaggttgtcagtgagcacaaaggatcatctaattggacctggcatggaaatttggaatgcagtccgaagtttatcatctccatttatgtcctggaaaagggaagatttcttttacatcctgacctggtttctgtaccacttacttaacaaataagcatttagagaatgtctctcatatatggtctctcagtaaattctctaagtagttctgggaagtagacattatctccatttttaaaacttcttatttgagatgtaatttacatacctaaaattcacccaattaaaacatgcaagtcagtggtttctagtgtctttaaagagttgtgcaaccatcaccactatctaattttaaaacatttttatcatttcatacccatcaaaagtcacttccccttgctcactcccccaacccctggcaaccactgatctattttttaatctctatggatttgcctatgctggacatttcatataaatggaattatacaatatgcggtcttttttgtctggctcctttcactttagcataatgtttttgagggttgaggtttcctttttatgacttcattcctttttatgactgaataatatttccatggtattgcttagccatgttttatttatccaggtcattatggtggacaactggtttgtttccactttttggctattatgacgagatcaggcgcattcggggtggtatccc

SEQ ID NO: 386068 - DNA, 509 bp, Homo sapiens
gctcttgaaaagatctcatgcaaataattgagctccctcttgtaattagatctataaccctgaagtgaggagaccgcagatgtagtctagcactattttaatttgggtgaaaaatggacacttttatttcaattgcttcatctataaaattaggaggttgtattatatgatctctaaagcccttctctagctcctaacatttctattattctgcgttcaggattcatgtatcaagtttagttaaaaatggggcatacttatatttgaaataaatgttagcttgattgcactaatttcccactttggattaggatcatcattttgttataaaaacatgtaaatataggttttctggtttaagaacaggaatgggaggtgtttgtagcatctaaacacacagattaggagctccatcccctcccccccagtctagcatatgtagttagagtattaaatgagatatggtatgtaggatttgatacaagataggtgctcagccgtataatttc

SEQ ID NO: 386069 - DNA, 424 bp, Homo sapiens
gtaaagagcctgaggaaattttcttcggccttcatcatgagaacctggtggggtttctggaagtaaaattcatgaaagtataaggggcccccaagacgggactccaacaagtttttaactctcaagctagtccacactcagccaccagtaaatttattgattaccattgaagtgttcctaccaattactggctctgtggcttctgctctcaggtaaactgattttctatagtcacccatctctctagtttttgaggaagtggtttccctgtgacctctattctcggagagatctaagaaaagttgttgattttcagtttgattatctttttttccgttgtgaagatgggagtgatgacttccaagttctctacatgttggagtgggaactggaagacctaattaacttcttaagaacggaaaaa

SEQ ID NO: 386070 - DNA, 202 bp, Homo sapiens
gaaactaaaatggtcaataaacttctgaaaaagtgctaaatctcattggaattaagaaattgaaaatgaaaatcatgaggatacaatttaacatctaccataatggcaaaataatcatctgattttcaactattagaaagtatggagagcaattaaaaactcaaacaataattgtgagaatgtaaattggaataaacaattt

SEQ ID NO: 386071 - DNA, 313 bp, Homo sapiens
gggcaaaactcagttctgatgcccatgcactcaaggttgactgaattttggcctggttctgccctcatcacacagtggagccctgagcaagtcagtctccctgatggggttcagtctcctcactgaggaaatgagtgggtggccagggtgacctctcaggtcttctagatttgacattctgagaaccaggggccacccaagccctggcccaggtgggagtgtgtaaaggaacttccaggaggatgccaggcaacttccagactgtagttaaagtcagagcacaaaggaaaccagtgctttctctgggggcttc

SEQ ID NO: 386072 - DNA, 1760 bp, Homo sapiens
tcagctcggactctgtgcgcattaggtcgattccatgtctttggtattgtgaatagtgctgcagtgaacatatgtgtgcatgtgtctttatggcagaatgatttatattatgcataaccaaaactgtacttattaaacaataacctcccaaccccttctgcccacaacctctgcctcctgggttcaagtaattctcatgcctcagcctcctgagtagctggaattacaggcgcaggccaccatgcttggctaacttttgtatttttaccagagacaaggtttcaccatgttggcaaggctggtcttgaactctggacctcaagtgatacacccgtcttagcctcccaaagttctgggattacaggcatgagccattgtgcctggccagtatcttgtcttctcattctgtaaacggtgtctttttttcattatgggaaagctttattgacacatttgtttttatttttaaaaattatggtaaaatacacagaacataaacgttaccatctgatatggtttggctgtgtccacacctaaatctcgaattgtagttcccataatccccacacatatgtaccacattttctttatccagtctttcgttgatagacatttaggtcgattccatgtctttggtattgtgaatagtgctgcagtgaacatatgtgtgcatgtgtctttatggcagaatgatttatattatgcataaccaaaactgtacttattaaacaataacctcccaaccccttctgcccacaacctctggcgactgccatgctactttctgtctctgaatttgaataccctgatagtcatataatatttatctttttgtgactggcttatttcactttgcataatgtattcaagcttaatctgtgttgtagcctgcgtcagaatttcttttctttttaatgctgagtattattctattgtgtgtatataccacattttatttatccattcatccactgatggacatgtgcattgttcccaccttttggctattgtgaaaaatgctgttatgaatatgggtatggagatctctccccttattttgagacaggatctcactgtcacccaggctggggtgcagtggtgtgctcataggtcactgtagcttcgacctcctgggctcaagcgaacctcccacctccgcctcttgagtagctgggaccacaggcatgtgccaccatggctgttaaatttattaatttgtttttctatggatcatgctttttgtgttacatcagaggagtctttgcttaacatgagatgacaaaggttttctcccatgtttcctcctaaaagttttatagttttaggttttacatttaggtctatgatccattttgagtcaatttttgtatatggtacaaggtatgaatctatgctttttaaaaaaatatggttacccaatttttctagcagtatgtgctaaaactttgctaaagtcacttagttctagtagctttttttgcagatttaaccagactttctacatagacaatcatatcttctgtgaataaacatggttttatttcttcatgttctaaaaaaaaaagaaacatagcaatgaaaactaaatagacccccgggccatttttgtggggggggggcgaaaacaagggggtttttggcaagggggcctggtgtcctaggtgttttcctcgcaccccattttttttctccccaagggggagaaactggcgggcccccctaaaaggagcgataaatttcgaaaacccggttaccgtaat

SEQ ID NO: 386073 - DNA, 1542 bp, Homo sapiens
tcagctcggactctgtgcgcattaggtcgattccatgtctttggtattgtgaatagtgctgcagtgaacatatgtgtgcatgtgtctttatggcagaatgatttatattatgcataaccaaaactgtacttattaaacaataacctcccaaccccttctgcccacaacctctgcctcctgggttcaagtaattctcatgcctcagcctcctgagtagctggaattacaggcgcaggccaccatgcttggctaacttttgtatttttaccagagacaaggtttcaccatgttggcaaggctggtcttgaactctggacctcaagtgatacacccgtcttagcctcccaaagttctgggattacaggcatgagccattgtgcctggccagtatcttgtcttctcattctgtaaacggtgtctttttttcattatgggaaagctttattgacacatttgtttttatttttaaaaattatggtaaaatacacagaacataaacgttaccatctgatatggtttggctgtgtccacacctaaatctcgaattgtagttcccataatccccacacatatgtaccacattttctttatccagtctttcgttgatagacatttaggtcgattccatgtctttggtattgtgaatagtgctgcagtgaacatatgtgtgcatgtgtctttatggcagaatgatttatattatgcataaccaaaactgtacttattaaacaataacctcccaaccccttctgcccacaacctctggcgactgccatgctactttctgtctctgaatttgaataccctgatagtcatataatatttatctttttgtgactggcttatttcactttgcataatgtattcaagcttaatctgtgttgtagcctgcgtcagaatttcttttctttttaatgctgagtattattctattgtgtgtatataccacattttatttatccattcatccactgatggacatgtgcattgttcccaccttttggctattgtgaaaaatgctgttatgaatatgggtatggagatctctccccttattttgagacaggatctcactgtcacccaggctggggtgcagtggtgtgctcataggtcactgtagcttcgacctcctgggctcaagcgaactcccagctacttgggaggctgaggcaggagaatctcttgaacccaggaggcagaggttgcagtgagccgagatcacaccattgcactctagcctgggcaacaagagcgaaactccatctcaaaaaaaaaaaaaaagaatggtgagcacaggcatccctgtcttgtttctgactttgggggagagtattctttctgcctttaaccattaagtatgttagatttttgtattgccctttactagtatgaggtgctaagggtttgttttaggaatggatgttagattttcttaaatgtttttatgcatctattgaaatgattacatggtttttcttttgtggtttgtttttaatgtagttttaataaattatattgattgattttcttatgataaaccaa

SEQ ID NO: 386074 - DNA, 417 bp, Homo sapiens
tttttttttttgaaacagagtcctcacccaggttggagtgtagtggtgcaatctcggctcactgcaacctctgcctcctgggttcaagtaattctcatgcctcagcctcctgagtagctggaattacaggcgcaggccaccatgcttggctaacttttgtatttttaccagagacaaggtttcaccatgttggcaaggctggtcttgaactctggacctcaagtgatacacccgtcttagcctcccaaagttctgggattacaggcatgagccattgtgcctggccagtatcttgtcttctcattctgtaaacggtgtctttttttcattatgggaaagctttattgacacatttgtttttatttttaaaaattatggtaaaatacacagaacataaacgttaccatctgatatggt

SEQ ID NO: 386075 - DNA, 313 bp, Homo sapiens
ccaggcgttggtctaggccctgggaatatggacataatgaggctcagtctctttcctcttcatgagtagaaaagataagaatagatttgcaatactatatacaggaagtgatcccatagatgagagattcttttgaggataccttagtggcacacctagccctgactggctgaatcaagaatgacatttcagaggaagtgatgcttatgctggatccttcccagtaggatgcaatactggcttatgctggatccttcccaatagatgcaatagtgtgtaattgctctccctgcttttaaaccacacccttagt

SEQ ID NO: 386076 - DNA, 401 bp, Homo sapiens
ctagaggatccccgttactggcatttcctcaagaaaaaaaatggggaacatataactaaaaggaatacttagaccttgcttaacaatacagaatttcagatgactgaattaggaggtggaggggaaaagtaagaagtgcagagacattcatatccgaaatctagcaaagtaaggggtcctcatctaatacaacgcacctataaatcacgagcaagaaactaatctgcatgtacaacctacacaatcacaaaagcagccaacgaagaacctaaaaacgcacgactgtatcaggaagaagcggaagcagggtagtttaagtgaactaaatcccctctctaggcaagaagtctaaaactgataaaaatgcacctgcatatccgctaaagaaacagaggtattac

SEQ ID NO: 386077 - DNA, 632 bp, Homo sapiens
ttggtctaatggattctatcctggagttctttcagaaacattacccagtctctattatgaactccagaatggtgtcacagcctgttaaatgcttatggttttttcaggaaataggttagggccagaacaagcccaacaatcttacctctgtgcctttgtgcaccttcagaggaaaccatagtcttaaacagctgctagaattttctagggaagcctttttgaaaattctgatttaatttggattccataatgcagcttagaaatgccacacgttctctgaaacacagtcttgactcaaattcctgagtactcctaaatcaccctgagataattatgatcagccagtttgtactatgcaatctacagtgattgctttgcagtaagccacatgaattctcctgtgacgaaaaaaaataaaggtttttctccccaccccccacccctctcttcctcttcttttccccttaactgtatagaagatcctaaaaacctctgtattcaagccaggcatgggggcatgtacctttagtcctagctactcaggaggctgaggcagaaagatcactttagccccggaatttgaggctgcagtgagctctgatcttgtcactgcactccagcctaggtgacag

SEQ ID NO: 386078 - DNA, 636 bp, Homo sapiens
agggtgacagcaaatatgttaccaggttttcatactatggggagaaaaaaaactttcttttaagagattatttgaaattcttttggtggaggacagaaggaaagcagtggctatggagatgttttctgctttttgcctactagcttaaagtgtttttatgacaggattccctatgacacagtctgagatattttgtcctcatttctcatttcatatttagccttctctcttctagagactggttccccattcatttagctacggtgtggaaacaatgcaaattaaactatgaacaaacatggaaaatgtgttttgcgtctaggttacttctgttttagaagagagtaccttgtcctaactccttatttcatttaatcatttctaaaaaaataattggtattatttgctaggtatttgcctccaaattaatactagaaggtgctattttaacactgtaaagactcctctgtgtttatccagaagaagcaattttaaaaaagagcaactaggctgggcatggtggctcacacctgtaatcccagcactttgggaggccgaggcaggtggatcacctgaggtcaagagtttgagaccagcctgaccaacatggtgaaactccatctctactaaaaaaaa

SEQ ID NO: 386079 - DNA, 204 bp, Homo sapiens
ggtctagaacctttttatatccagagcctggagcaggaccctcaggacagctgtcagaaatgatggcagaagggccgggtgcggtggctcatgcctgttatcccagcactttgggaggccgaggcgggtggatcatgaggtcaggagattgagaccatcctggataacacggtgaaaccccacatctactaaaaatacaaaaaa

SEQ ID NO: 386080 - DNA, 361 bp, Homo sapiens
ttaggagaacatgaaaatggctatagcaggcactacacaaagcagtaaaatgcctcttataaagagtacctatagctgtccaagcgcggtggctcacacctgtaatcccagcactttgggaggctgaggcgggcggatcatgaggtcaggagatcgagaccatcccggctaacatggtgaaaccctgtctctactaaaaatgcaaaaatttagccaggcgtgatggcgggcaccggtagtcccagctactcgggaggctgaggcaggaaaatggtgtgaacccgggagccggagcttgcagggaaccgagatcacaccactgcactccagcctgggcaacagagcgagattccatctcaaa

SEQ ID NO: 386081 - DNA, 307 bp, Homo sapiens
aaagccccttttacagatgggatagtaggtccagagaaatgtgttggttttcagttccagagtaatttcacctgctcccaccctccacactcacaaagagcaggctgggtgggatgtcgatttttttttcttctggagaatggaccatctccctatgcctctcctcctccttggctactaacccctgacttttccctcccccttctctggccactcctgttcctgaacaaagccagggaagatctgggctggctcagcccctgggtgtcagtcaagactcagagggagactttgctcaaaaagccag

SEQ ID NO: 386082 - DNA, 402 bp, Homo sapiens
aaactctaagcctcctaaccaattgagtggaccccgtcttgccaagggcactccagagtaaatctgaaaaactagttcaggccatgatgggaaatgaggtttggacatgcctcattataccctcctctctttggaattcagggacaactgaccagcattaacatcaaaacagagatcttaagactgaccaaacagactctctgtagtaataaaatacatcactaaatgacagatagcaggccctgacagaaataaaaatattttaccctgaaatatatttctttgatgtattttaaaatggccctgcagagatgtctcttgtgggggaaatctacatactgtagagaatgtcctcccctttctaggtcttttcctgatcctagagagataaagagtctggta

SEQ ID NO: 386083 - DNA, 327 bp, Homo sapiens
agtatgactgcacagctggtaaagccggctccatggacaggacttccccagcaagagaagcaggtagctcagtattgctgatgagagtggctgttccaagcatcagtaggcctggaatctcttctctctgctaaagagtctcactgatgcaccagcattcttgggtggacttccttgagcagaagcttagaggaaggaaataatacagattctggttttgcattttccttccattcagatccttgacttataacatcagtaatgacttccagaagtattttggcaatcccatcttctattgagggaccaagatgtctattactatca

SEQ ID NO: 386084 - DNA, 330 bp, Homo sapiens
cagcccactcagaaaagtcaagttccaagtttccaactcagatgaaatgtttcacagttctacttcttctcatagttggcaagtgacaatatagcaaacggaggaagcttccctgattattagactttctggacctcttttgtcttgcaaaacaatattttgaatgacacccaagtgattcagaagtaaagactcaactgacttaccaatactgacaacgtggcatgcatcatgtgttatgaatttttcctcctttctaagaagacatcttttagtctttgctgacttggaatgtgatgcaactaatgggttttgttttcatggggtacc

SEQ ID NO: 386085 - DNA, 437 bp, Homo sapiens
aaaacatttgaggtttcagtgaaatttttaggctcaaacttagaggcatatacagcaatattttgcatgtgttttcatggcattcaggaccctgtatcctattcatgaactgcagctcaagaatgcctggtctatttaaagagcctttagtggcaagaggcattcgacttccccttgcctttgctgtgcctgggtaaggacagatcacccttagcacttctcttttggattaaaattcctgcccagttatcttaagaacaggccctttcctgcttagaggaggcagcccaagagaccccatttatatggcagtaataacagcaaacgtctcctaaaaggctctgccatgcagctggatatggatagaaacagaacagttatttgaagactgagcgttcagaataaaggtcactttggctctcagttaatctttgagg

SEQ ID NO: 386086 - DNA, 253 bp, Homo sapiens
cgccaacaggacaaagaggccactctgtcagcctctgctggacccctgagctcccctctcatgggcctctccgtttgggtggctccgagaggccaactccagccccaactgcaggctcccaggactgcaggggcagggactctggaggtccgtgtgcttcgtgagagaggggaccctgtcctcctagcaggggtccagcggcaccacagcaagacttctgtggccaagtacacgccatgctcagctctgcccc

SEQ ID NO: 386087 - DNA, 358 bp, Homo sapiens
aaacagcagttaccagcttggggggtggggtcaggctgccattgagatgttttcttccccacccccgggaaaagaatctactctaaaaatgaaactctcactctgccacacactctgccatctgctggggcaaggggatgcttcgttggtctcccaagccttccagctgtggcagctgctctggatctgggggtagtttttgtctcctactgccagctgcagtccatgtagacggaggaaccagcgcaggccccagaacggcaggcgcttctccactcccctctggatgctctcgccccgctgggccccaggaaagcctgtggcaacctctcgagcaagggtattggggtcagaatgg

SEQ ID NO: 386088 - DNA, 144 bp, Homo sapiens
agttggattggagaaatctagaagaattcaggacctagcctagtctacaggcaaataactagaacttgaagctaatgcacagagctaccatttatagtttttatagtgtattatagcactccagcctgggtgagagtgagactc

SEQ ID NO: 386089 - DNA, 709 bp, Homo sapiens
gagatatgatgctttggggcttgtatgccaactccacagagtcctcagagatctaggctccttctagtcacaactatcttctttagggcatgatatgtgtccttatattaaaaaatggcttgtagagctccagctctcatatccatattccatggagcagaacggaggaaagaaaagaacaggcaaggggtatatacatcagctgtcttttaagatgctttcccagaaggcacaaaaaacatttccacttaatttcatcagccaggaattagtcatatggtcacatgtaattgggaaggtgaggctgagaaatatagttgtttagctgggtacattttgttgcctcaaataaaactagaggtcctaaaactgaggaggagggggagaatgaatattggctataggcttctagcaatttgccctaattgggttacttgagtcatgaagccacacagaccctgccaaatagctgacagacttgctttccccagcttcactgacagaccatggtggcttctaactgcggtctggaaatagccctaaatattgcctagctattttttctttctttgagatagggtctcactctgtcaccgaggctggagtacagtggtgcaatcacagctcaccaaggctcaggtgatctcccaggctcaggtgatcctcccacctcagcctcctgagtagctgggactacaggcacacacca

SEQ ID NO: 386090 - DNA, 384 bp, Homo sapiens
attcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaat

SEQ ID NO: 386091 - DNA, 330 bp, Homo sapiens
tggtccagagggtagaagtctgtctgcagtgactacgcacggttaaaaccttcccttaaaacagggtgcacagactgtccagacctggcgtggacctcacagagggctgtgcgtggggaaggcccagaggaaagggagtggggaagaagggagatggatggtggtaatggctgcatgcaatgtcaccaaattgtacactcaatgtaaataaaaaactctatgttgggattacagtcatgagccaccgaggcaggtggatcacctaaggtcaggagttcaagaccagcctggccaacatggcaaaacctcatctctattaaaaatacaaaa

SEQ ID NO: 386092 - DNA, 347 bp, Homo sapiens
ttaacatctatgctgcatcttccctcactctcttcaactccagtaaccttctcgtctatagcggcctccacccatgaccatggaaaggagcttcccagaccctggaccagctccatgactgaaatcctagctcccaggcttcaactctctgacctataaccttagcccctctcaacttttcttccttactccaatttcctctgttatttcatcttcagaggcaagatcctattattctttttaaaatatatatttttttttattgagatggcatcttgccatgttacctacgctagtctcaaacccctgggctcaagcaatcctgctgcctctttctcccaaagtgt

SEQ ID NO: 386093 - DNA, 1594 bp, Homo sapiens
gctaatgtttctcccagaaactaaacaacatagtttaggggatattaggcctacattctaatcacattgtaaggaagtgattttctaattttgaagcttcccaggagcagccccctccaggaacaattttccctgtgaactttcactgagaaactattatatgccatggaggagtcaaagatgaattaaatccaatgctatcctccaggagtgagctttgtagttggagagaaaagccaaccttatagatacaacctgtacatatataacctatgctgcatttaggcagatgataagccctaggaatggaaagagggaaaagctcccttttgccaggaatgatgaaggaaagctttatggaaacacaggctgtatgtgaaagatgggtgaatctttgcaggtagggaagaagtagggggcatgtctggctgagaaccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtacttttagttgtcttgcctctttatttcagataatgcctgtgattagtgaatggcggcattattcctgaagacaaatgaaggaagatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaaagctttctggactaaaaggatataagcagctcaattagcagcatagaggattagattaatggaacagcactgcatacaggaaagctacatctcc

SEQ ID NO: 386094 - DNA, 4564 bp, Homo sapiens
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggggcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacga

SEQ ID NO: 386095 - DNA, 793 bp, Homo sapiens
ttctcttaaagggtaaaatattcatcttgtcattctaaacattaatattttaccctttaaagagaagggtcaagaagagaaaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacga

SEQ ID NO: 386096 - DNA, 4637 bp, Homo sapiens
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggggcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgaaacgaaacacagacaagtagaccaaacaacacatgcaccggccgcccagagcaccacggcaagctttccaacc

SEQ ID NO: 386097 - DNA, 3737 bp, Homo sapiens
agagtggtgccctccgtgtactctcttggaggatgaacttggactgctgctccatcacactgtacttcctaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgt

SEQ ID NO: 386098 - DNA, 4019 bp, Homo sapiens
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggggcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtggatgaaaggggatctggtaccgagctcga

SEQ ID NO: 386099 - DNA, 3503 bp, Homo sapiens
  misc_feature (3485)..(3485): n is a, c, g, or t
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggggcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcaaaaaaaaattaaataaattattataccctttcagnaatgctgtgtgcattttc

SEQ ID NO: 386100 - DNA, 351 bp, Homo sapiens
gcggccgcctactactactactgctcgaattcaagcttctaacgatgtacggggtcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacga

SEQ ID NO: 386101 - DNA, 4481 bp, Homo sapiens
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggggcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgt

SEQ ID NO: 386102 - DNA, 4484 bp, Homo sapiens
  misc_feature (4444)..(4444): n is a, c, g, or t
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggggcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtctttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgaagcaacanaaaaaataataattattttatatattatatttttataaat

SEQ ID NO: 386103 - DNA, 2714 bp, Homo sapiens
agagtggtgccctccgtgtactctcttggaggatgaacttggactgctgctccatcacactgtacttcctaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccaacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgtttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgt

SEQ ID NO: 386104 - DNA, 288 bp, Homo sapiens
caggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgaggtaagaacagaattctttaccatgggaaaaacttaattttgtcaattttgtcattagttctgagcgt

SEQ ID NO: 386105 - DNA, 412 bp, Homo sapiens
gtttggtactttactcctagtttaagtcatctctttcggcccatacaggttgcctggggcagggcggtggtgagtgtgttgagtcggccctataccctgttccacaatgcctggtgtccttggcacgtagcttgcagggctgcttccatggatggctgcctcatcccccacccctccttcatggcaccctcttttctccaactccttttcctctgctgagtcctaccttttcttgccagaccagggatttgccaattattctggatgggcacagggaaggggccctcagatcctgcagagggagcatctgaaagacaatgagaccctgtacacaaccaagctgagcctcctgtaagcacatcctctgggtgtcactatgcgaaaagactctttgtctgtttacattgcacaa

SEQ ID NO: 386106 - DNA, 516 bp, Homo sapiens
taaagatattgaattttgtgccattaattgttcagcatacctttttcataagtgaaatattttattcctgcttttgctcgacttaaaaataaatgactgggttccattttgtctttccctcccaaatttcctttaggcatataccaagtatgtgtggaaatgtcgactcaaatagaatattttggaaataagttatctacaattgtacaaagcaggccagagtagcattctcttcctatacttactgatgatgttactattgcaatagtatcaataatctccattaaggagatttaaacaaaccaaaaattctcttctgaaaaatttcacttgatttcttcaattctgtacagtccacgaattcactcgtacaagaaaacatcaccaaagccaatgggtttgtaaaatccacttgttgaaactatgtgtgtgtcagcagaaggagggttgggaaggggttgcttttcttagaaaacaataaattaatcaaataatacataatcatttcactaagta

SEQ ID NO: 386107 - DNA, 2231 bp, Homo sapiens
  misc_feature (728)..(728): n is a, c, g, or t
  misc_feature (847)..(847): n is a, c, g, or t
  misc_feature (862)..(862): n is a, c, g, or t
  misc_feature (1622)..(1622): n is a, c, g, or t
  misc_feature (1707)..(1707): n is a, c, g, or t
  misc_feature (1746)..(1746): n is a, c, g, or t
  misc_feature (1773)..(1773): n is a, c, g, or t
  misc_feature (1776)..(1776): n is a, c, g, or t
  misc_feature (1789)..(1789): n is a, c, g, or t
  misc_feature (1795)..(1795): n is a, c, g, or t
  misc_feature (1803)..(1804): n is a, c, g, or t
  misc_feature (1819)..(1819): n is a, c, g, or t
gccttggctggccatgtgcacctcattccatgccattccaacagttgctgtgctcccaggcttatataagaagaaccagttttcccacttcatgattttgcagcttaatgggatggatatggaagagaataacttagcttctagacaggcacaatcgcagacgtacacagaggctggaagacggtgcacaccattgagatacgtgtctcatccagcccgccacatgcagccggaaccaggccaccgcctgggtgtcccttgtgtcctgtcctcctacctcttctctctggtccccacattccttccagagtttctcatacatggattgctcccaggctcccttccattgggggccagaggttctcacagagcacagagaaggggaccattcgcccctgggaccatcaggggaatgatctagaagtcaagcaaatgttctagcccttcagggtcttcaagggagattacgggggaagaaggctgaggtagagagcagggcctctatacatttaagctcatagagatacagagcatatgaagatatgggaattcagaagagttccgtccaacagaaatgtaatattgtaaagtaacagcagcagcagcagcagcagcagcagcagcacttgaatatgataccaacaaacaggaagtgtcaggaagacgccttgcagaactgtcagcctgtggagttgtttccccaagagagtttggagttagaaagagantgtcctcttcctgtcacatgtgacactgggactactcactctcatcaagagaaacatgacacttctcacaggggtgtagactagccccccacgataatcatgcaatagccctaacatcnattcatgcactgggntgttcgtgaattaatattaaataatattacagaatggacagcaagggaattcaattccttcttatatcaccctgagagtggagcctacaaatcctcctgagtctttgaggttctctattcctgttatccttgaacaagaaaatgtgcacatgtacacacacacacacacacacacacacacaccactaatttccctgaaaacacaagaatgagcaataatagatatgcacagacaaaatgaagtgatggggattttatttaccttctaccctgaaacaatcaaaacacagacaaaatatgtgatataatgttttcaagtcactggacatcaaacaatgaagggcagtgaaccctctgagatagcaaatgaacaataatgaggcctccaattgctcagtctgtcttccttgatagtgtttccaggctcctgttcagagaagggggaacccaggcagagctcagtggagtccctgagttggagagacacaactgagagtatagagaaatcccagaggcaggagctcacaggacagaattccagcaaggagagtactgcacaggaagaatgaccaggaggcatacagagggtgcagagggtcaccactgagggttccagtgagtacttatgatcacatgaaaacctcccaagtttggggaaggaactactcaaaaagactggaagtaactggagctgaccaaggcctgagaacagtgcctgtttctattagccagactgaagaacttcatgattcacaggacntttggtttgaatacacagagagccttcccttaatcagtggggaataagtagaaatagactcagcattgttatggtcctacctagnaaatcttaaaagccagactcaaaaggatcaatctatttncagtaacttaattgcatcccagaatanagntcaataatattgnaaggantacagcanntttcagcacccaacnccaggcattcagggaagcagaagaatataaccctcaatggagagatccaataagcacagagaaccttaagtataggaagatgtgaagaaaattacacgaaagcacatactaaccaaattggctaaaaccaatgactaagagaacatcttaaaagcagtcatacaaaaaagacaaaaggaaaagacagacaaaataaagaggagggaagataagggtgacagcagatttctcagaagaaacaatgcaagtgagaagccattggagctgcattttaaaagtactgaaagaaaaaaattgccaatcttgaattctgttcccagtgaaaatatttttcaaaaacaaagatgaataaagacttttttcagattggaaaagcaattccatcaagtgaatatattataatttttctatt

SEQ ID NO: 386108 - DNA, 362 bp, Homo sapiens
atacaagtggaagtaaaaaggtggagatagattaatagcctaaataacgagagaaccttatgccttttttaaaacaaaacaaaaccattgagacattttacttagtcctaaaatctagcctggatttatgctataatgatatctatttttcatgttaaattgtacattactcagaaattataaatattattactttataatttgaaattgtgtttgctagccaccttgatgtattttcttccaaactcccattaagatactattgaaaaaatagaaatagtcaaatatttgcaaggtataattgttaggcaacatattatagcatgtgttaagtttctgctaggcctatggaaatttttttt

SEQ ID NO: 386109 - DNA, 1174 bp, Homo sapiens
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccaaggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggtaaccagccccaaggtcccccacctcctccaggaaagccacaaggaccacccccacaaggaggcaacaaacctcagggtcccccacctccaggaaagccacaaggaccacccccacaaggagacaagtcccaaagtccccgatctcctccaggaaagccacaaggaccacccccacaaggaggtaaccagccccaaggtcccccacctcctccaggaaagccacaaggaccaccccaacaaggaggcaacagacctcaaggtcccccacctccaggaaagccacaaggaccacccccacaaggagacaagtcccgaagtccccaatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccgcacaaggaggcagcaagtcccaaagtgcccgagctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgca

SEQ ID NO: 386110 - DNA, 775 bp, Homo sapiens
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccaaggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccccacaaggaggcaacaaacctcaaggtcccccacctccaggaaagccacaaggaccacccgcacaaggaggcagcaagtcccaaagtgcccgagctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgca

SEQ ID NO: 386111 - DNA, 715 bp, Homo sapiens
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccaaggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggaaagccacaaggaccacccgcacaaggaggcagcaagtcccaaagtgcccgagctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgca

SEQ ID NO: 386112 - DNA, 359 bp, Homo sapiens
gtgcttcacatgtgtcagacactattgggtatcaacaaattcatgaccaaatagataatttcttaatttaattttttcagagacagggtcttactatgttgccctggctggagtgcggtggcgcggtcatagctcattgcagcctccaacacctgggctgaagcgatcctcttgcctcaggctcccgagtacctgagactgcaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatccca

SEQ ID NO: 386113 - DNA, 2942 bp, Homo sapiens
  misc_feature (262)..(262): n is a, c, g, or t
agccagtggcgctgcgctgactgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccntccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaatgccgaagcaaa

SEQ ID NO: 386114 - DNA, 2526 bp, Homo sapiens
  misc_feature (262)..(262): n is a, c, g, or t
agccagtggcgctgcgctgactgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccntccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaatgccgaagcaaa

SEQ ID NO: 386115 - DNA, 1258 bp, Homo sapiens
  misc_feature (262)..(262): n is a, c, g, or t
agccagtggcgctgcgctgactgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccntccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatcccgaattccgccgatactgac

SEQ ID NO: 386116 - DNA, 2805 bp, Homo sapiens
agccagtggcgctgcgctgactgcaactgcgcgcgcccgccgggtgagccagcgatctgagccaggcgggggcggcccgacctttcccgcccagcctgggtcagaggaagccgaaagcggcctcagcaagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaatgccgaagcaaa

SEQ ID NO: 386117 - DNA, 2448 bp, Homo sapiens
  misc_feature (262)..(262): n is a, c, g, or t
agccagtggcgctgcgctgactgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccntccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttgagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggacaagaaggggctttccgggaaacagaataatttcgagcgcaaagctgtgtaccagaggcaagtcagagcccccagtttgctggccaaaagcattttagaaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaataaatgccgaagcaaa

SEQ ID NO: 386118 - DNA, 381 bp, Homo sapiens
cttctcaactccttttcctttctccttgttggtaagtatgtaccctaaacacagattccattactgtcaacgtaatgtgttttcaggagagagtggaggtaagctaaaggtcatctactctgtataatcagaactgaataatatgattgtggtaaatgaaaaataaagagatggtaaaaggcttcagattgtcataatgattctattttgcatgtcagctctgaggttcagtcgaaatacttggtgtgtataatgtctgcagaagcgtagcagtaactcatacttggtgttctttggttggtggcagatcatgctgcaatcagttggactgaaagttaaatttggaaaagttatttaaactcttctgttgcaatgcaggtt

SEQ ID NO: 386119 - DNA, 136 bp, Homo sapiens
tattcctgaaaatgtgttgtagccttcaaagttaggaatatatagtctgcaatcgtaccatgaaaacctcccaaaatgtaaggtcttaagtgtacaaagcaaatataaattcttttaaaaataaaactattttatt

SEQ ID NO: 386120 - DNA, 251 bp, Homo sapiens
tccctaaatagatcagaattatttatgtagaaggtcttatgaaaaatatttaggaaattcaggtttggaatttctgcattctatgaatttctacatatgaaatcagaaacttaatttttctgaaatacagacactaattccatataggcaaggtttgtatgtttgtaaaaaataagagaaatcacatcacgtttgaaaattgccttggccacctgaaaaagagcaggcttggccgggcacgatggctcaga

SEQ ID NO: 386121 - DNA, 598 bp, Homo sapiens
aaggaatgcatgaagtccacccagcacccactccagttgtgtccctccatcctcccagactcccccctgcccctgcactcccagccatgccccctgtgtgggcctctggtcctctcaccctctacctttgctggagaacatacaggactcacgtcttttcctcccacgggacagaaactcctttcgcgcttcctatcaggccctgcctacagcaggtatacactgcggggtttctcagtgaacagagcataccaatttgcacccgccacaggacagtggcttgttccctgcagacaacttactctttcagcctccaggcgtttgctcctccagcccagagggatggggcagcaatgagcatttgagccgccctagaagcaggaggcaggaggcaggaagatatctggatagttcaggaaagagatgaggaaaaaggaaaaaggcataggaaaaagatttgggagctagggttgagccagcccctttctctgggcagcagcagactatggctgtcctgagtgggcacacgcaaggctctggggctcaccccgtaccctcttcacctatacccctcccctgatccatctgtagccaccca

SEQ ID NO: 386122 - DNA, 309 bp, Homo sapiens
gagcgggggggcgggccgcagctgtcagagccgcggcggcgaacgaggcgcagcgagctgagcggtggcagcgccgcagccggggccggagcgcaggagccgacggggcccgaccaggatggtgcagtggcggctccgcggcgcacgcacgcgctgagcgggcccagcctgggccccgagccccccgtgccccccgccgccccgatccgggccggcatgatgtgcctggaatgcgcctcggcggcggcgggcggcgcggaggaggaggaggcggacgcggagcggcggcgccggcgccaggggggcgca

SEQ ID NO: 386123 - DNA, 2904 bp, Homo sapiens
tcttttttaacttaaattttattacttatacagaattcttatttatactttaattataggtgtgacgaagagaaagagagtagggaaatacacaggcagtggttttaagtgtagatgatggctccttaacccagtgtcattagataatcaaacctaaagtcttcccatattaggcaagcgcaattctctattttggacccttcccattcttcccttaccttctgcttttcgtactgaggaatttcgtgtgattttagataaagtgataatgagatattgagcaaataagaaaatagaggtaatgctataaaaaactaagctatgtacactttcaaaatgcatgtttcttgcatgctttttactacttaattgcattctttgctaatttcctttccttgctgtctgttcttttctaacagctgaagaatgttctgctgactctgacctcaactttcttattcctgttgcagtgggtgtggccttgggcttccttataattgttgtctttatctcttatatgattggaagaaggaaaagtcgtactggttatcagtctgtgtaatcagttaaatctagtgtttgtttgtttttttcaattagaagttacgtttccattggctaaaagccaggacatgctgtgcaatagattgtttaagatatgcagactaacttcagtgagttcctagctaacttgggcatgagtacacttatttaagacaaaatatattaggaccaatttttttctgttttttttcttcctttgttaaagtataattaaaagaaaaattgtggcttagaattttttaagtaaataatgattttaagcccctggatccaattatgaaagcatttttgctgatgtgtaattttatatgttacagttacttatattttactactttgatgttatttgcaaaatcaaaggtgttaaagaatttaacttgcttcaggaaataaattcaagaacatagtggattcattttcattggtggcagacacgaaatttggttcatgataagacttcctttccccacctcctgatcagcattatttaaatctgtatttttctgttagttaagaaagaaatggcttcatgatattgtatttaatagcaaaagtttggctgtcttcttcattactgttaatagctactatattttaacaaggagatttctttttttgttgttgttgttctagagtttggaatatactgattatctcagacttgacatttatactgaaggatgaagtaagacctccagctttttttaaaaaaggtgttgatttggaacacctgtatgggttatggtttattaaggttatggtttagaaagtttttttccctcagagccttaacttgttaagaaggttcatttatcctgcactgaaaacaaaaactctatatactttgtttgtgtgcctcctgcactctcccattccctatgtgaatatgctctagttgatatttttaatatattgatttcttttttctcacagcaacaagtgcttactctagaggttagtgggccctgatatgtcatcagtcagatgcctgcctagccaaagctggactaagattattctgtacatttgttgatcttgatatagacttatatccctgtagggactgctaatggctccggcttctggagtaaggtactggagaccactcatccctgtgtctgcttgattggttcagctgttgaattgcccttttatttggaagcagtgttgaagttgtctagggttcaaatggctgctttgtacacctgtcattagtataaggcagatgtttattttatcaagctattttatctctacatttaactaaaaacaaaagttcccaaagatctgccttcacttcagaaattttttttggattaaaaaaattaagcctgaaccttaaataaagtgagttggttattcattccaaggattaagtcccaatctacctctcagcacaatgcagaagctcaccactgtattgctgccattaactcatgccagaaccctttgccaataactggaattacaaatttttgttaaagaaaatttatcaagatctttctttactgccttctctatatgtacatctcaaaaacatgtacatctcaaaaactggagtagaaagttagattgctcaactacaactcctctagaactctatagctctgacatacagattcacactctcctctatttgctaagtatgtaaagaatgttttcttttaaaatgttctcttttgagaacaactgcttatttgttataaaagcatttggttaaaatgatgtcatcataaagaacagtggctttgtttcaatacatatttttgagatgattatctagaagccagattaataaaatcagcttgtgaccttgctaagcatataaactggaaattcagatacattcaaaattatgggttcatttaaaagtgttctaccttttgggtatgagactaatatcactaattcctcaatagttatcatggctctatcttaattaattagaaaatatgtgtgtttaattctttgagaattaaaatagagaatattaacagagggttaaaaactgcttcaactccaataagataaaggaagctcaaaatctatgagctgagtgttcaattagctttgcctactgagttcaattttatgtcaatacaacagtggatcagacagtacgactttgaactggtgaatgtaaacaattgtttttcacctaagctgctttggaagaactgatgcttgctgctaactaaagttttggatgtatcgatttagagaaccaattaatacctgcaaaataaagcatactgtggtacttctgtttgatctagtatgtgtgattttagattgatggattaaaaattaataaagatcatacattccataaaaaaaaaa

SEQ ID NO: 386124 - DNA, 2850 bp, Homo sapiens
tcttttttaacttaaattttattacttatacagaattcttatttatactttaattataggtgtgacgaagagaaagagagtagggaaatacacaggcagtggttttaagtgtagatgatggctccttaacccagtgtcattagataatcaaacctaaagtcttcccatattaggcaagcgcaattctctattttggacccttcccattcttcccttaccttctgcttttcgtactgaggaatttcgtgtgattttagataaagtgataatgagatattgagcaaataagaaaatagaggtaatgctataaaaaactaagctatgtacactttcaaaatgcatgtttcttgcatgctttttactacttaattgcattctttgctaatttcctttccttgctgtctgttcttttctaacagctgaagaatgttctgctgactctgacctcaactttcttattcctgttgcagtgggtgtggccttgggcttccttataattgttgtctttatctcttatatgattggaagaaggaaaagtcgtactggttatcagtctgtgtaatcagttaaatctagtgtttgtttgtttttttcaattagaagttacgtttccattggctaaaagccaggacatgctgtgcaatagattgtttaagatatgcagactaacttcagtgagttcctagctaacttgggcatgagtacacttatttaagacaaaatatattaggaccaatttttttctgttttttttcttcctttgttaaagtataattaaaagaaaaattgtggcttagaattttttaagtaaataatgattttaagcccctggatccaattatgaaagcatttttgctgatgtgtaattttatatgttacagttacttatattttactactttgatgttatttgcaaaatcaaaggtgttaaagaatttaacttgcttcaggaaataaattcaagaacatagtggattcattttcattggtggcagacacgaaatttggttcatgataagacttcctttccccacctcctgatcagcattatttaaatctgtatttttctgttagttaagaaagaaatggcttcatgatattgtatttaatagcaaaagtttggctgtcttcttcattactgttaatagctactatattttaacaaggagatttctttttttgttgttgttgttctagagtttggaatatactgattatctcagacttgacatttatactgaaggatgaagtaagacctccagctttttttaaaaaaggtgttgatttggaacacctgtatgggttatggtttattaaggttatggtttagaaagtttttttccctcagagccttaacttgttaagaaggttcatttatcctgcactgtatgtgaatatgctctagttgatatttttaatatattgatttcttttttctcacagcaacaagtgcttactctagaggttagtgggccctgatatgtcatcagtcagatgcctgcctagccaaagctggactaagattattctgtacatttgttgatcttgatatagacttatatccctgtagggactgctaatggctccggcttctggagtaaggtactggagaccactcatccctgtgtctgcttgattggttcagctgttgaattgcccttttatttggaagcagtgttgaagttgtctagggttcaaatggctgctttgtacacctgtcattagtataaggcagatgtttattttatcaagctattttatctctacatttaactaaaaacaaaagttcccaaagatctgccttcacttcagaaattttttttggattaaaaaaattaagcctgaaccttaaataaagtgagttggttattcattccaaggattaagtcccaatctacctctcagcacaatgcagaagctcaccactgtattgctgccattaactcatgccagaaccctttgccaataactggaattacaaatttttgttaaagaaaatttatcaagatctttctttactgccttctctatatgtacatctcaaaaacatgtacatctcaaaaactggagtagaaagttagattgctcaactacaactcctctagaactctatagctctgacatacagattcacactctcctctatttgctaagtatgtaaagaatgttttcttttaaaatgttctcttttgagaacaactgcttatttgttataaaagcatttggttaaaatgatgtcatcataaagaacagtggctttgtttcaatacatatttttgagatgattatctagaagccagattaataaaatcagcttgtgaccttgctaagcatataaactggaaattcagatacattcaaaattatgggttcatttaaaagtgttctaccttttgggtatgagactaatatcactaattcctcaatagttatcatggctctatcttaattaattagaaaatatgtgtgtttaattctttgagaattaaaatagagaatattaacagagggttaaaaactgcttcaactccaataagataaaggaagctcaaaatctatgagctgagtgttcaattagctttgcctactgagttcaattttatgtcaatacaacagtggatcagacagtacgactttgaactggtgaatgtaaacaattgtttttcacctaagctgctttggaagaactgatgcttgctgctaactaaagttttggatgtatcgatttagagaaccaattaatacctgcaaaataaagcatactgtggtacttctgtttgatctagtatgtgtgattttagattgatggattaaaaattaataaagatcatacattccataaaaaaaaaa

SEQ ID NO: 386125 - DNA, 363 bp, Homo sapiens
aggactggaatgctattgcctgcatggctaactccctctctttcttcaagtcttcattctgatgttactttttccatgaagcctgtgctgaccaccctatttaaaatgtcaattttccttcttttccaaatagtcacttcctgtcccccttgccttgctttgttttttctggggcaccgatcacttactgtataatttagttattcattgatcagttagtcttagtctacattagaatataagctctttaaggacaggaattttttgctgttttattcacttctgtatcccaagcacctataatagcacgtggtaggtagtcaggaaattatttttaaatttataaataactgtctaatctat

SEQ ID NO: 386126 - DNA, 298 bp, Homo sapiens
atcgcggccgcgtcgacgccagctgtattaggagaactctacgattgaatagtttgcaaatattttctcccattctataggttgtctcttcactaggttgtttgtttcttttgctctgcagaaggtatttttgttgttgttgttgtttagttaaatataatcccatttgtctttttgtttttcttgcctatgcttttgaggtcttaaccataaaatctttgcatagacctttcctgtaattataatgctggctctttcctcccaggctctcatagcaatgttcccacagatatccaat

SEQ ID NO: 386127 - DNA, 225 bp, Homo sapiens
ctgtatcatctttattttgatcctttcgtcataggccattgaaaacttaatcataaaatggtacatgtatatctgaatttttaagactgactgaccaaggggactacagaatacccagtagaatcaaagtaattgtcatgttcctctgtattaatctagtctactttgggaccttgagttctcacctctcattcttttgctaacttcctctttaccctttagtta

SEQ ID NO: 386128 - DNA, 817 bp, Homo sapiens
gagggaaactactcatataaaagaagaggttatgtaactctccagaggaattggaagaaaaacagagagttctgttttgaatgggcatttttcttaagcaaatggaatttttttctctctcaatgtaaatgaattaaaacccaaacccactggtcacaaaaggctaattgaatataatcagccattttatctattggatagaaacaagcatatcctgaattatgttggaaatctctgctttagggtggaattttgtctgttctaactattccttgtagtgttaaaattccccttgagaagcaagtttaacatgtgtttgaagattgactctaagaggttgccatggttttctacaaatgttttacaaccagctaaaggcaaacgtaccctttgagcttttcaatcttttcttgaaatcactcagtcattacttcctagagcaaatgctgcttcaggacccagcccagtctaatagggagtggacttcagtgctagctctaagaaatattcagctactgcatctagctataggagcaatttaatagttcttccttctggggctcttttaaaactaatattcaagatcttgagactagcagaacattatatagctggaggttttcaccttttagaggagacttcaagggatttgctcactcttattctgccagcacttttagaaaagtatgatacttcatttcctgggcatcaagtagggtagctgtcaaaactgaaatcatctgccagggccagccatctctggatgagcatggcagattgtgctgctcatacagggcacggatttgatgtggcgtgg

SEQ ID NO: 386129 - DNA, 273 bp, Homo sapiens
gaaaacattcactcactcatttactcactcactcatctaacaaatacgtattgggtgcctgctgtgtacatagcactgaattttaatgtcagccaccatttcagatgtttagaaatgttttaatcacctgtctgaattttacactgcgcaccccacctccagtcctgaagtattgccacagaaggttgccaggaaattattattcattattctctaaacttacagaggctccaagcctgaaatttctcacacaccatgatggaaagatggcct

SEQ ID NO: 386130 - DNA, 636 bp, Homo sapiens
gcctgacgtattatacggctgaggaaagatcaagaatgtgagggaaacccatgcccttaacaaaaacttctcttctgaaagacaagagctcaccccaagaaaaaaaggactgggattgaacagagcaggaacacttggggtaaaggagaaaagctttagatacaagaaagaggtggccaatcccagaaagtacaggagcaaggactacacagaccgaccacagcaggggaaaggcctctccagctgtggagttcagaaagctactctgacccacaactgcccgtacgtagaacatcctgctgaaagaacaggaaaagatgctgatcacaccctgtacaaagatattgcggggagaaagtgaaccagataacctcccacagataatgaaagcacaccagaaaaacattcctccaggcagatgaaaactgtgtcctgatgtttctgagtgatctcaaaggaattagaaaaacgacagaaactactaaagaatggtataaattaaaaatgtttaaaaagctcaggttaaaagtgactagtcaacagaaaaatatgaagagagttgacaggactcaggaggaaataagaaaaaaaaaaccagatatttctgaaatgaaaatcaggaacacaagaatgaaa

SEQ ID NO: 386131 - DNA, 232 bp, Homo sapiens
aaactccaaagtcaaccattgtaagggaacatctgtatagggaagaaagggtatataagtgccgtaaagggggcactttttaaggcatttatacccttttctgggccccatctagggctagatttgactttgactctgggggaagccactgaagaccccatctaggggctgggtgcagtggctcacgactgtaattccagcagtttgggaggccaacgcaggcagattgctt

SEQ ID NO: 386132 - DNA, 751 bp, Homo sapiens
gttgtttgaagcagtcacaagcctgccagattgaagggtccatagacccttacctctcaatagaagagcatcgagaactgtggaaccatgttttacagctgcaacaatggtcacacggaaccccaggagacttgcaatcagaagcaccaaaggccagggtgtggcacagccaccctgcagaaggcaggagagttactccttggagacactgacccaggaggctctgaacttggagattccagtcggagttgaggacacagaacctagatggagagcaggtgaattaagtgaaaacctgctttctgaatagtcagatccctcccactcagccctccactcagttttgggaatgttgccaccaggattatgcccgttacccagaatgtcaaaggattcttctttggtgaaactgagaaaccaaagaaaaatgacctattaattggcataagaccaccaggtacccatctgataaacctacagtgaagtgatcctatgacaacctctggtcatccacactgagcttccagccagccgactggggccttaattagtgaaagagatggccctagacacctgagcagctggggaaagcctctgttgggaagacacaagcacgcaaacaaacaaaacagcaacaaacagaaaaaaggaactcagggaaagaagtacaatgcattagaaaaacaaagacaactcaaagaaaatgcaaaaaaacaaagaaatagccaatggtgagatgttaaaaagataa

SEQ ID NO: 386133 - DNA, 499 bp, Homo sapiens
tctctgatatttacactaagatgttcagtggggggaaaaatcagtcttaacgctcagagataaataaccacattcatgacaatgagattatgtaattgttttttattcacaaatattttctggcacacacattaattcacagaaagaaagaacagtagtcacgtgggcacaatatttaaccctttcagatactgaggtttatcaccgcttgatttcttagttggaaatgttgcagtttggtttcaggcaggatttccaggctatcacagcctgctccgatggcatgattattaggagctcatctgcatcactggtgaatttctttggtcacttctggacagtttttaaacataagtccatgcccttctttgttctgctgatgaggcacgtcataaaataaatgtccagcaatgtcttcccgtcttgttctcaggcctcaggctctcggactccttcccccaaccctgcccccatgttaactttctattgctgctgtaaa

SEQ ID NO: 386134 - DNA, 630 bp, Homo sapiens
ccgtcttcaacctatgcttccattttcaagaacaagacatcttttggctagatacacttctgtggccaggatcatggttgtcttcccatctaagtttggccagtgcatacacaggcctgtactggccaggatgataaatgtgaagattggactgcatttcatggctaggttctccacttggttattttctgtcctcccgtggttattttttctgttcttgtagaaaagagaacaaagcccgtttaacaactgcaaagcacacagtctgcagagaccttaaagattactggcaacaaaacatatttatgtctttaataaggaattgaaatttaccactcactaaaattttccttctcttttctttctctgttttctctttggaacttgttggtgttaggaggatcagtctggtctccaggatgttattttgatgtcttttgttttctgaggaagtattttacagtattttctgacagtgataaaattttgaggtaattctaaattcttgtgtacgtgctcaattttgaattacgtattacaatattttgtatggcttccaagtatctcaagtctgaaagagtatgtggcatataataaatgaaagtgagtgtgagagtttattgaaagggc

SEQ ID NO: 386135 - DNA, 709 bp, Homo sapiens
gtcactcggacttggaggatggtgaatgtggggattttattgagtaatggaggtgtctctcagagggatggatggggagctggaaaggagatggactggaagattatcttccccctggagtccagctgtccctcggccagtctcctctctgaccatccccagccgaacccctcccaacattcagacgcaccttctcttctctccttctctgcctcaccgccctgccgttcttctactcttctttttttctgctcatggagcttggggtttatatggacacacgataggggtgtggtgagccagagtgaccttggagaaggcaacatttgggcatgaaaacaggaaagcttgttcccatttagggccgtgggtttccaggcttgggggcggggcctttgctggggaaacgcccttctgcttcctgtccgtatcagcatgcatgtgatgtaatcatgtgcacagtttcagggagggaacccttttcctctactctcttaggttttgtattgagggcctgaaaattaaactgaaaaaaaaagacaacatagcgagagaaaaaaaccctcagatttaattacatatgtatgtgtgggagttcacaaagaagtgtgacccaaggaagcagttagaatttggggcttatgtatcatcttaacaggggaagggacacctctgggagaaatgacttcttagacgaaggggagaaggg

SEQ ID NO: 386136 - DNA, 306 bp, Homo sapiens
tttctatcttcttgcaaagattcagattcaccagcaattggtatagacattgaagtggagggaggcctgtaaataaacatttacgaactggagttgtgggggagcctcaaagtttacaatagttattgattggtgagcttagtaagccttagcatagactgcttggtaatgttacccctttgagagtgaaagtaacaaagatcagcaaataacgtataagcatcttttcaaaacttgaataaaattcataaaagaaaagggtttttttttttttttttaacataacaagaaaagggcattgtctcc

SEQ ID NO: 386137 - DNA, 947 bp, Homo sapiens
taaatttaatttttatttataattagcacacggtattgtacatattcatagggtacaatatgatggttcaatgcatgtatagatagtgtaatggaatccagccattctattactgggtatatccaaaggaaatgaaattggtaggtctagcagacatctgcacacccatgtttattgcagcacaattcacaataacccatatattgtataaacctaaatgcccatctaatgatgaatggattaagaaaatatcatacatatacacaatgaaatacgattcatctacaaaatagattgaaatcctgtcatttgcagcaacatgggtaaatctggaggacacgaaataagccaggcacaagaagacgaacactgtatcatctcactcatatgttgaatataacctgttacttcttaggcaataaataaatggagattttttttttttacttacagctttgatagagcatcgatgttgagccattgaaaaatctgatggagcagaaagtttaatactaaatctaacctctggcagatatttaggacaaaacacccagggttctcgagctactttggtctcatagtggaattatagagattattctacgttcttgaaaaagggatttcagatgtcattcttcctttctttgtctgacatagaaagttataagccaggtatggtggctcatgcctgtaatcccagcactttgggaggcagaggtcggcggatcacgaggtcaagagattgaggctatcctggccaacacggtgaaactccgtctccactaaaaatacaaaaattagctgggcgtggtggctagtgcctgtagtcccagctactcaggaggctgagacaggagaatctcttgaacctgggaggcagaggttgtagtgagctgaggtcaggccattgcactccgacctggtgacagagagagactccatctaaa

SEQ ID NO: 386138 - DNA, 278 bp, Homo sapiens
gagctggtaccgtcacgcccacagactcctgtgttggaaatgtggaaacgatggaatggctgggccctcataccaccatcttgctcagtcattggacagggacacccaaagaaaatcataaacttggtccaaaagctgagtagaccctgtaggagccaacagtggtaggctgccagctgagcacagccttgaagcagggcagtttttttttgtttgtttgtttgtttgagaccaagtctcgctctgtctcccaagctggagtgcagtggcacgatctc

SEQ ID NO: 386139 - DNA, 615 bp, Homo sapiens
cagcacattgggaggccaaggcaggcagatcacgaggttaggagttcgagaccagcctggccaacatggtgaaaccctgtctctactgaaaatacaaaaattagctgggcgtggtggtgggtacctgtaatccctgctacttgggatgctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatga

SEQ ID NO: 386140 - DNA, 668 bp, Homo sapiens
cagcacattgggaggccaaggcaggcagatcacgaggttaggagttcgagaccagcctggccaacatggtgaaaccctgtctctactgaaaatacaaaaattagctgggcgtggtggtgggtacctgtaatccctgctacttgggatgctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatgactttggctggaagcaaggttaatcctttaaaggaggaggacaggagaacttaa

SEQ ID NO: 386141 - DNA, 1253 bp, Homo sapiens
  misc_feature (820)..(821): n is a, c, g, or t
  misc_feature (835)..(835): n is a, c, g, or t
  misc_feature (855)..(855): n is a, c, g, or t
  misc_feature (903)..(903): n is a, c, g, or t
  misc_feature (1126)..(1126): n is a, c, g, or t
ggcacgagccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctctctgtgcttatgtcatctctgttattgtccccagcttggggctcccctatccagaaaatgttgtcagtgtcccagtggtgacatctcagtttgggaagtgggatgggaagttaggaaagatatgggaagaatgggaaaaacaaactgacactccaaacccccacttccctcatttttatttatttatttatttatttttttcttttttttcattttttttttttttattatactctaanntttagggtacatgngcacattgtgcaggttagtnacatatgtatacatgtgccatgctggtgcgctgcacccactaacgtgncatctagcattaggtatatctcccaatgctatccctcccccatcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggacatgaactnatcatttttatggctgcatagtattccatggtgtatatgtgccacattttcttaatccagtctatcattgttggacatttgggttggttccaagtctttgctattgtgaatagtgccgcaataaaca

SEQ ID NO: 386142 - DNA, 581 bp, Homo sapiens
ggcacgagccacgttgtcttctttccttcaccaccacccaggagctcagagatctaagctgctttccatcttttctcccagccccaggacactgactctgtacaggatggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctgggatggctgtcactggctgtgcttgtggctatggctgtggttcgtgggatgttcagctggaaaccacctgccactgccagtgcagtgtggtggactggaccactgcccgctgctgccacctgacctgacagggaggaggctgagaactcagttttgtgaccatgacagtaatgaaaccagggtcccaaccaagaaatctaactcaaacgtcccacttcatttgttccattcctgattcttgggtaataaagacaaactttgtacctc

SEQ ID NO: 386143 - DNA, 829 bp, Homo sapiens
agcccaggcgcagcgggaatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcaaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaataaaaaaaaga

SEQ ID NO: 386144 - DNA, 775 bp, Homo sapiens
agcccaggcgcagcgggaatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcaaaacgtgaaaattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaataaaaaaaaga

SEQ ID NO: 386145 - DNA, 542 bp, Homo sapiens
tctctatgacctctctatgcaatggtgtggcactgccttttcaagagaaaagtaaaagctgtacatggcagtgaccagttctccttgcatttggaatgtaggtcaggatccatctgattgaccttgtgttcagaagcgcgtcagcaaatcctgtttctaggccctccactggtgtcttccctgctgcaaagagagggcttctcaaagctggggggcttgaggcaagaggtcatgtgtttgagcctgagatgtcagcaggcaagagaaggaaaggcagccttgctccttcaattatgcaaggtccatattccttctccatgtctttaccccagtgcacggccacagaagagcccagctgctgagctgatacaaggcatcctctgttgagccttcatctgacctcacttggcagacgtcagcagcagtaaacatggcttgaacatgttgtcactgagctgcatgatgattgttagagacgtaaaagagtttctgtcataaacagtgtacttgggtgatgaatagactctcaaaagaaaaaaaga

SEQ ID NO: 386146 - DNA, 457 bp, Homo sapiens
cctaatcaagcaaaactaaccaacacaatattttgtttaggagtatatactactaaaaaaggaggaggatataaacacaaaattcaggatggcagctacttcagggcaggaggcaaaattacagtctgggaaaataacatgatatggaaaacagcagtagaggtttctgccaccaatttggcaacacattggctgcctcccagatctaccaccctgaaatgaaaagaagcctttcgagatgcttattatctctgagtcaaacggaaaagaatcttatggacgccacctcagattttagaccagcagatatggggggacatcaatcacatagaggcacacctcattttaccgcactcaactcacagatgggtagttttgttttgtttttaacaaattaaaggttttgtggcaaccctgcatcaagcaagggtatcagtgccatttttccaacagcaaa

SEQ ID NO: 386147 - DNA, 720 bp, Homo sapiens
ctatttgatcaacctggagcaaggaaatatttgtctaatgctagtattaatatttttcaatagataggatacggagacttatctaggggtcacttttttacttgggtgctattctagtcccagatctatggttgaaaatgtttgtatgtacaattctagctcaatttagtaaaatagtgctttgtaggcctccatgcaacaaacctcagctctattgagaaggtattttcccctactcaccggctggttctctcactccgaagcaatggagtacataaaatagaaactacaggcctcagtgtacactgctgctaactcttaccattagcaacaacctacaacactttatttgtgtatattacatctcccaggatgtaacgtacttctgttagtgcttttactacttcttcctacccattttctaggtttctgccaccaatttggcaacacattggctgcctcccagatctaccaccctgaaatgaaaagaagcctttcgagatgcttattatctctgagtcaaacggaaaagaatcttatggacgccacctcagattttagaccagcagatatggggggacatcaatcacatagaggcacacctcattttaccgcactcaactcacagatgggtagttttgttttgtttttaacaaattaaaggttttgtggcaaccctgcatcaagcaagggtatcagtgccatttttccaacagcaaa

SEQ ID NO: 386148 - DNA, 388 bp, Homo sapiens
attgttggtaaatttaattcctagagaaaacatatggtgttaaatagaaaataatattgacatatatggtccctgtttcttttctcctggtgaggagaaaagatttctgtttgtactatttgcacattgcataattgtaaattttaccttgtaaagaattctgttcttcaggactgagaggggatctagaaatggaaatcatttggtactttgagaaacttttcttctagcttcttgataacataatttaccttcttcattttcacattattttagcacatttgattgttaatgaactattaatgactgtcttctttgctcttcctaccctcttaaaaggaactagttgggcagaagataaaagtgtcagcttgcatctctgggtatt

SEQ ID NO: 386149 - DNA, 847 bp, Homo sapiens
  misc_feature (702)..(702): n is a, c, g, or t
  misc_feature (755)..(755): n is a, c, g, or t
  misc_feature (803)..(803): n is a, c, g, or t
  misc_feature (822)..(822): n is a, c, g, or t
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcaccccaaagtacagtacgggtggctggcaagatggccgaataggaagagctccagtctacagctcccgcagagatcaacgcagaaggtgggtgatttctgcatttccagctgaggtatctggctcatctcatcgggactggttagacagggggtgcagcccatagagggcaagccaaggcagggtggggcattgtttcaccagggaagtgccagggattggggaactccctcccctagccaggggaagccaagaggaactgtgccctgaggaatggtgcactctagcctagatacgatgcttttcccatggtcttcacaacccacagacccggagatttcctcaggtgcctaccccaccagggccctgggtttcaagcacaaaacaggaagccatttgtgcagacaccaagttagctgcaggagtttttttcataccccagtggtgcctggaatgccagtggacagatctgtcattcccctggaaagggggctgaagccagggagcccagtggtctanctcaacggatcccaccactacagagcccagtaagctaacattcattggcttgnaattcttgctgctacatacagtctgaaatcgccctgggacccctaacntggtagggggaaggcgtcnccattctgagcttgaatactggttt

SEQ ID NO: 386150 - DNA, 472 bp, Homo sapiens
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttagggtacaagctaaatagttatgttcttgttgtttgagttggattaggtgtttttatcgctagtgtgttgaatgacgcgtgtttgagtgtcttgttgagagaaggttttgttttataactgagcacggagcgtagtatctccatgtggtcttcagcaatcttcatacttcagcctctggggtagttggaactattgagcgcttgccaccacccccggctaatgttttccatttt

SEQ ID NO: 386151 - DNA, 442 bp, Homo sapiens
tattgacagagaaactagcttttttcatttctgcaagtatcagaacatttaaggtcatttagcaaacaaacaactgatacatgctgggaaccactttaatatttaggaatcaacgaccaccaaaccagaaatgccaaagaatcatggccgccaaaaactcagtagactacttcctgccatatggatggttgtgaccgcagtgtgtactcccaggctgaaatctaccacttctagtctattagacacagggacagctcttgaagttctactcagcatagtggatagcaaagttctgaaacaaaaactatctcaagatgtgataaaataaatacacataggggaagattctggcaagatgctgaaataggaagctccaggaatctgtttacccatccagacaacaactgcactggcagaatctgcctgatgtaactattttgga

SEQ ID NO: 386152 - DNA, 498 bp, Homo sapiens
aatttttatatttttagtagatacagagtttctccatgttggccagccaggctggtatcgaactcctgacctcaggtgatccacctacctcggcctcccaaagtgaccactgcgcccggcgcctttggttcttacatgagcctcctggagctgctgtgacaatgcaccacaaaccagggggcagggggaggcttgaaatttattctctcacaagtctggaggccagaagcccaacatgaagatgtggtggggccgtggtgcttctgaaggctctggcgggaggatcttctctgtctcttccagcttctgggggtggcctgccatagttggtgtcccttggcttggggccacatcactccaagctctgcctgcatcatcatgtggccttcttccctgtgtctctttctccttttttgtttttatttttattttttgagatggggtctcggtctgtcacctggctggagtgcagtggcaagatctcggctcactgcagtc

SEQ ID NO: 386153 - DNA, 582 bp, Homo sapiens
tggttcaagctattctcttgcctcagcctcccgagtagctgggactacaggtgtgcaccaccatgcctggctaatttttgtatttttagtagagagggggtttcaacatgttcgccaggatggtctcttaacacctgacctcaggtgatccacctgtctcagcctcctaaagtgctgggattagaggcgtgagccactgggcctggccggattttactttcttttctcctaagagagaacacccttgtgagctaggcagggcaagtggagcaatcgcaatttgcagatgagttaattgatgctcaagcaatgagatgacttctcagggcccttggcctgatcattaagggcagggtgggatgagatgacaggtgggcctctcttcttggacagctctctgctgacagctgccccagagctacatttgaggcctggtgtcttgctgtgttcaggcttcatatctgatgagagtacctccaagtatagccgggaaaactgcagctctgccttccctcttcatgcagctaccgtttcaggaagcgggaggctagggtggggttgaggctacattgtgctaccatg

SEQ ID NO: 386154 - DNA, 218 bp, Homo sapiens
tatgggcattttcaaatgtaaacaaaagtagaagccgacagtataatgaatacccatgaccctaccatcaagcttcaacagttagcaaacattcgccattctgcaaagagccatcctttggtatttgtgggggactggttccagggcccctctcagataccaaaatccatggatactcaagtatcttatataaaatggtatagcaggccgggtgcagt

SEQ ID NO: 386155 - DNA, 251 bp, Homo sapiens
ttttaattcacttcagtttaataaattactcgtatgtttggcagttttttagatgcacaggagataaaagtactagtttctgcttctaagaagcttacaaactatgagagaaatagacacaaggtttttgtttgtttgtttgttttccttcgttttattgtgaacatcaagaaagttgaaataattgtagagtgaacacccataaatctaccaccaagtttctatgacttctaatagcttgttgtatttgc

SEQ ID NO: 386156 - DNA, 456 bp, Homo sapiens
attcctctgagccccagtttcctcatctgtaacgtggatttcataaaaatcacttcttgtattgtaagcgttgaaagcatgaatatacatataatgtaaataatttctcattggataaatcacatgaaaagtactcaataaataaaacattattgtttgttaattcttgatttagagccatctgagtcttttctgtacccttgtagataccttggtcagctccatggagcagagctgagttgacagttttggtggtagtgaactgctaaggaatagaatgtttgatgaactaatatcccctattccatgagtcaacatatccattcctgcaatgttactgagggaaggccctgggctgtcatcactgtgacaatgctggtgcaataattcaatgaattctttctgcttgttgcacagacaaaacaaattcactgagatggtgacactgcagtaaaa

SEQ ID NO: 386157 - DNA, 563 bp, Homo sapiens
atttcatagtaggcaaaaattgaatataacccaaggtctaacaatagaaaattatgaaacatgttgtaggacaaatgccattcagccatgaaaatacatatttataaatactctttaataatataaaagtgtgagattgtatatgccatatgataccagttttacatgaatatacataaatgtgtttataaaaatgtgtatgtaggtccacaatttcagatcccaatcctttaggccagattcattttggaattcagagtttttcagatttttggaaaggtaacatgatgcatacactacgtattgtgtaaataacccagtggggcctggggttacaccattattccattatattaacatttctgcagcaaaacataagattattcactctaggataaacaagaagaataaattcatggttctgtcattgcctttcaccctccttctgggaattcctttgtctttctcctatcttattttgtttgctgaattcggtgtatttctcttttttggtttactttcatgttttggtagagcccattttctagtggcatcttcagaaa

SEQ ID NO: 386158 - DNA, 2905 bp, Homo sapiens
  misc_feature (28)..(28): n is a, c, g, or t
  misc_feature (33)..(35): n is a, c, g, or t
acaggcttgctggggatgaggtgacaangcgtnnncgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccagatggagaaggaaaggcaagtgacttgtccagagccactctgtcaaaaggggacttgagtcctcagggctgttgactccaaagctgacaagcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386159 - DNA, 993 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaacacccagaga

SEQ ID NO: 386160 - DNA, 2934 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386161 - DNA, 2689 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386162 - DNA, 2653 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386163 - DNA, 2741 bp, Homo sapiens
ggtgcctcctggccaaggagcccagcaccagccttttggagaagactctgcagctcccgaggaatggaaagctgttagggaagggaagggggacgttccaggccaagggaggggcacagggaagtttgcgttaggaatttctcatcagaaaaggagatgtgacgggggagaatggattccaaacaatgcccaccacaaggcaggcccaggaacagggccaggaaagggtaggatgtgatgtggtatgtgaagctatgtgaggctgaatctgctgccttcagggggccacactttctaatttgttccctttccttccctcacccagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386164 - DNA, 2637 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386165 - DNA, 3012 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386166 - DNA, 2611 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386167 - DNA, 2926 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagccttgaagcagaggtctcctggattgggtgccctttaagctactcgcagttctgaatcgtgtggcaggcctgatccaagtgaccattttccttctagtttgactttgggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386168 - DNA, 2809 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaagcaggagagcaaagggagaaagctctaggctaaaggccagaagacctagccctgccaataaaatcaacctcattttgtgaatgcctgttgtgtgccaaggaccctgctaagtgctttgcttgaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386169 - DNA, 3429 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgagcactcggatggccgcccagtccggccggctacccagggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggatgagcagcaggcctgaggtcccaagccgtaagccgagggctggcaccctgctgcccctcaaaagccagaggcagagccagccttgaagcagaggtctcctggattgggtgccctttaagctactcgcagttctgaatcgtgtggcaggcctgatccaagtgaccattttccttctagtttgactttgggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaaaaaaaaaaaaaaaaaacctttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatc

SEQ ID NO: 386170 - DNA, 2198 bp, Homo sapiens
aagctgggttgggtgcccctgctctgtgctgtgacatcctgtactatgactacctgattactcatctagactgtgaaccccatgggggcaggaaccatgtcacattcaccactgtatccctggttcagggcctgacacatacttagcaggtgttcaataaacctttgatcaatggtgggatgaatgagcaaatgcctgagcagggagagagccttcttatagccgccctaatgtcctattctagattccttaggtcccctcctctcacctcctgcctttgttgtggaggaggaagaagacagggagaaggaagaggaggaggaggaagaagaagaagagggaaggatgtgtttgagttgctttatgccttcacttaaggctcactgtccttaggggaacctgagctgttcactagggacagacacattagtggcttgggcaagtggtgctttgggattttatttttggaaggaggggggatggaggaggatcaaaccactttttttttttttaaccagcaggagagcaaagggagaaagctctaggctaaaggccagaagacctagccctgccaataaaatcaacctcattttgtgaatgcctgttgtgtgccaaggaccctgctaagtgctttgcttgtacgtaatcctcagaacaaccctctaaaggaggcatgatgagtacttttatcatcaccctccccattttacagataagcacactaaggcacagaacagttaaaattcctgccaggaaagactcaagtcagacctttctgatccccaaaccactctgcctgctaggccccgggctgcggcttcaggatgggggcttgtattctctgtgactctgctacacctagatgctcccactcccacagtcaccctggtcatttctagaaggcaacagcagcaggatttgacacatgccccacattaggctaagaggtctcaggagaaatgggggcctttggcacaaagactattggcagataatccagggctgggaggaacttattggcaggaaatagcctgcactgcacctgcaggaggagtgaatcttcagtgttggttaaggaaatgcaggctggccgggcacagtgatgtgcacctatagtcccagctagtcaggagactgagacagaagaatcacttgaggccaggagttcaataccagtctgggcaacatagcaagaccccatctctaaaaacggacaatcaaactaagaaactatgtttccattaaagcatattatttagttacataacagtaactaccaaaagaagcagcccaaactattcccgtgattgtttctggggagtagatttgggggccaatgagctgtgatggaggacacttacttttcatgacttttccaatggtattagtactttaaaccaaaattttacttttttaaaaagcaagtatgtcaaggcaaaggatccttctcacttataaatgtgtataaaagaaatttctttttcctccccctccactccttctatttctgccctatttttttccaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386171 - DNA, 877 bp, Homo sapiens
atggcggcttattctcttttgctggtctttgacacgttgggcggtctttgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386172 - DNA, 1310 bp, Homo sapiens
aagctgggttgggtgcccctgctctgtgctgtgacatcctgtactatgactacctgattactcatctagactgtgaaccccatgggggcaggaaccatgtcacattcaccactgtatccctggttcagggcctgacacatacttagcaggtgttcaataaacctttgatcaatggtgggatgaatgagcaaatgcctgagcagggagagagccttcttatagccgccctaatgtcctattctagattccttaggtcccctcctctcacctcctgcctttgttgtggaggaggaagaagacagggagaaggaagaggaggaggaggaagaagaagaagagggaaggatgtgtttgagttgctttatgccttcacttaaggctcactgtccttaggggaacctgagctgttcactagggacagacacattagtggcttgggcaagtggtgctttgggattttatttttggaaggaggggggatggaggaggatcaaaccactttttttttttttaaccagcaggagagcaaagggagaaagctctaggctaaaggccagaagacctagccctgccaataaaatcaacctcattttgtgaatgcctgttgtgtgccaaggaccctgctaagtgctttgcttgaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386173 - DNA, 2617 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggcactttatggagtgggcacacattatggaggatggggattattgctgtataccttacaaaaccaaatgtaattacattatcttggtaaattaattagaattatggaatttatgataaggctttctgtgagacaacacagaattaaaattcagaaagctgtttgaatcattagtgatgctttcttctaaatggacacccagcgaaagactcatgagaggtgtatcctctagagtcagccaagagat

SEQ ID NO: 386174 - DNA, 2298 bp, Homo sapiens
  misc_feature (2284)..(2284): n is a, c, g, or t
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcgggtcgttgagnatcctctagagtca

SEQ ID NO: 386175 - DNA, 2641 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaagcaggagagcaaagggagaaagctctaggctaaaggccagaagacctagccctgccaataaaatcaacctcattttgtgaatgcctgttgtgtgccaaggaccctgctaagtgctttgcttgaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386176 - DNA, 1183 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaacacccagaga

SEQ ID NO: 386177 - DNA, 127 bp, Homo sapiens
gaccctctgacctctgacctttgcttcccggcagatttgaccacctggtggccatagagcgtgccggaagagctgctgatggcaattactacaatgcaaggaagatgaacatcaagcacttggttga

SEQ ID NO: 386178 - DNA, 297 bp, Homo sapiens
ggaccagtcctgcagatagttctgcttcctagaggcaggctgacagacacatgacttttccaactccatgatggaatcttgttttgctgttctaggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggtaacaaaccccagccagccgctcgcctggaagcagcttttaccctggat

SEQ ID NO: 386179 - DNA, 498 bp, Homo sapiens
aatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaattgtgtactcttcggaatatcgtgatgaaatctcacaccatcctgctccatcctacctaggacgtgaatcctccctttgtccagggtacccgtgctgtctacaccacccgcctgccagtcacccagcaggtgatcagatcgactgtcatggtattgcagtgcttatattcaagaacctcttatgtgactcagtaatgtcctcaaagtgcaagagcagagatgctggcaatttggatatgccaaaaagaggccataaagggcttcctttaagtga

SEQ ID NO: 386180 - DNA, 2704 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386181 - DNA, 1017 bp, Homo sapiens
  misc_feature (28)..(28): n is a, c, g, or t
  misc_feature (33)..(35): n is a, c, g, or t
acaggcttgctggggatgaggtgacaangcgtnnncgaggtggcaattggggaaggggttctgggctgccgcaggcacacaggccagagcttcgtggatacctgcagggcccaaaggtccctccctgttttgaagagtgagtgatggctatgaggtagcggccaggctgatcacccctgcgttggctggaggcagaattctgtaaatcctcgccaagtctttctccaggccactggttagctcatctcagcctcctctgggagcatcaacaccaacatggcacaggggactgcagtggtgtgctttggacctgtgtacccacccaaggctaaaggcagagccaggagccaagttacaccctgtttaaccctgccttcaaagggacgactctgtaagaattctctggctactttaattcaaggttgacacgatgcccttccagcttgtcctttggggaaatgggatagcggaagagaaaggaggacgcccccgaggaaaaaaggtgacgagagaagagagcaggagaaaacaccatggatgaggagccgatggagaaaaaaaggcggacgaacaacgggagcgggataacacctggaacaacatataacagagtgagacagaatacaacaatatacaatacgcgcatagagaaaatgcgtgcaaccgagccaaagccaggagcggcgaacaaaccacacaacacgaaaccacggggaagcagggcagcaaccacaagcacaacagaaaggcagcaaggagaggcaaccacaagagacacggagcaatcaacgacagaaaggagcaggcgcacaaaaaaagaagcagtaaacccacaggaaatgaaaacacacacccaggagcgagagacagggtaccaacgagcaagcaggcaggagcacacgccagagaggagagaagaacaacacaagcaaaaagagagggagagagaggaaagacaaccagtaagagcaaagtagaccacaagagtgtggagagaagcggaagagacatcgcgag

SEQ ID NO: 386182 - DNA, 3105 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagtaagtcagaagggaacagagcacagcacagtccctccctccgccccaggcagtatccaccttgccccgccccacctaaggagcccaagggtattctgggagcccaccccaggacaatggcagggcaaaaccagtgagcaaggcagaaaattcctgaaattctccactgaggcccagctgttcctctccttgaaaagtcaaggcttggttcaagccagatagcacctgaggacagaacatatcagatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386183 - DNA, 2850 bp, Homo sapiens
gtcgctcaccagtccgcagctcgtgcttgacagtgaggagctgctctcctccgtcgccgccgtccgcgctggtccccgcggcgccgccgctgctgccaccctcctcctccatcttctcctttttttccgatcccgcgggtcgctacgaggggaacccaggagacagcggacgcccgtcccctcgcagccgctgccgcggccccaggagtcggggtgcggcggctccagaactcggacgcaaagacgagtctctttcccgctctggccgcacggctcgctcctcgcctcctcccccttcggcgggcaccgctagtaccgcgcaaccaaaccgccccctgctccaccgccgcctcctcaggccgctccgcccacagccagcaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386184 - DNA, 2860 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacaatggagaaggaaaggcaagtgacttgtccagagccactctgtcaaaaggggacttgagtcctcagggctgttgactccaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386185 - DNA, 1966 bp, Homo sapiens
aattatggagtagcctgagttgtcaaagccttaatccctattctccttcacctcttcctcaaataccatttacaataatcctgcaatttgagtttctgttttagagaaagaaccataaactactcaaccagttctaattggatgctccctgctgaggaaattacattttccttttccatctgcagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386186 - DNA, 3697 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaagcaggagagcaaagggagaaagctctaggctaaaggccagaagacctagccctgccaataaaatcaacctcattttgtgaatgcctgttgtgtgccaaggaccctgctaagtgctttgcttgtacgtaatcctcagaacaaccctctaaaggaggcatgatgagtacttttatcatcaccctccccattttacagataagcacactaaggcacagaacagttaaaattcctgccaggaaagactcaagtcagacctttctgatccccaaaccactctgcctgctaggccccgggctgcggcttcaggatgggggcttgtattctctgtgactctgctacacctagatgctcccactcccacagtcaccctggtcatttctagaaggcaacagcagcaggatttgacacatgccccacattaggctaagaggtctcaggagaaatgggggcctttggcacaaagactattggcagataatccagggctgggaggaacttattggcaggaaatagcctgcactgcacctgcaggaggagtgaatcttcagtgttggttaaggaaatgcaggctggccgggcacagtgatgtgcacctatagtcccagctagtcaggagactgagacagaagaatcacttgaggccaggagttcaataccagtctgggcaacatagcaagaccccatctctaaaaacggacaatcaaactaagaaactatgtttccattaaagcatattatttagttacataacagtaactaccaaaagaagcagcccaaactattcccgtgattgtttctggggagtagatttgggggccaatgagctgtgatggaggacacttacttttcatgacttttccaatggtattagtactttaaaccaaaattttacttttttaaaaagcaagtatgtcaaggcaaaggatccttctcacttataaatgtgtataaaagaaatttctttttcctccccctccactccttctatttctgccctatttttttccaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386187 - DNA, 3739 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgagcactcggatggccgcccagtccggccggctacccagggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaagcaggagagcaaagggagaaagctctaggctaaaggccagaagacctagccctgccaataaaatcaacctcattttgtgaatgcctgttgtgtgccaaggaccctgctaagtgctttgcttgtacgtaatcctcagaacaaccctctaaaggaggcatgatgagtacttttatcatcaccctccccattttacagataagcacactaaggcacagaacagttaaaattcctgccaggaaagactcaagtcagacctttctgatccccaaaccactctgcctgctaggccccgggctgcggcttcaggatgggggcttgtattctctgtgactctgctacacctagatgctcccactcccacagtcaccctggtcatttctagaaggcaacagcagcaggatttgacacatgccccacattaggctaagaggtctcaggagaaatgggggcctttggcacaaagactattggcagataatccagggctgggaggaacttattggcaggaaatagcctgcactgcacctgcaggaggagtgaatcttcagtgttggttaaggaaatgcaggctggccgggcacagtgatgtgcacctatagtcccagctagtcaggagactgagacagaagaatcacttgaggccaggagttcaataccagtctgggcaacatagcaagaccccatctctaaaaacggacaatcaaactaagaaactatgtttccattaaagcatattatttagttacataacagtaactaccaaaagaagcagcccaaactattcccgtgattgtttctggggagtagatttgggggccaatgagctgtgatggaggacacttacttttcatgacttttccaatggtattagtactttaaaccaaaattttacttttttaaaaagcaagtatgtcaaggcaaaggatccttctcacttataaatgtgtataaaagaaatttctttttcctccccctccactccttctatttctgccctatttttttccaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386188 - DNA, 1194 bp, Homo sapiens
cctgcaaaagtgtaaatctgtgaagtgctaaaccaagcccatatacttccaagtggtaagtggactgtaggaccttgtgaaaaatgggcccgggacccctaatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggtgagcaacgaacactcgcctggcctgggaaactgcatgcccactttctgggaggggttagtgcaggtgccgtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386189 - DNA, 2485 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacaaaggacaacatttctctggggctttttaacttttattcctaagactctaaaggcgttgatttcaaccctccttcactctggcttcttcaggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386190 - DNA, 2521 bp, Homo sapiens
acgtgagctcaggctgtgggagcggatggagctgctacagtcagcgcttggggctggcctcagcttgtagacccgagccctgcagaacaaccccccgtggcgcaggagagcagaagaaagggggcctttatgcccttttgagggaagcacacattctgcaaggccgtggaaacaaagggaggaactgtttgtagccctcgtccagacgccccaaacaaacagagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggatgggccatccccagttctggaaatacgagttcggtgcctgcaccggcagcctggcttcgctggagcagtactcggagcagctgaaggacatggtggccttcttcctgggctgcagcttctccctggaggaggccttggagaaagcggggctccccagaagagacccagcaggtcacagccaggcgggtgctacaagacaacagtgccttgtgttacccatgctggcttctgctgccctctggtggtcacgatgaggcccattcccaaggacaagctggaagggctggtgcgggcctgctgctccctcggaggtgagcaggggcaacctgttcacatgggcgacccagaactgttgggaatcaaagagctttccaaacctgcctacggggatgccatggtgtgtcccccaggggaggttccagtgttctggccttctccgctgaccagtctcggagctgtcagcagctgtgagaccccactggcttttgccagcatcccaggctgcacagttatgactgacctgaaggatgcaaaggctccacctggttgtctcaccccagagagaattccagaggtccatcacatttcccaagatcctctgcactacagcatcgcgtcagtctctgcttctcagaagatcagagaactagagtctatgatcggcatagacccagggaaccgggggattgggcacctgctctgtaaagatgagctgctgaaggcctctctctcgctgtcccatgcccgctcagtgctcatcaccactgggttccccacacatttcaatcatgagcctccagaagagacagatggcccaccaggagctgttgctctggttgccttcctgcaggccttggagaaggaggtcgccataatcgttgaccagagagcctggaacttgcaccagaagattgttgaagatgctgttgagcaaggtgttctgaagacgcagatcccgatattaacttaccaaggtggatcagtggaagctgctcaggcattcctgtgcaaaaatggggacccgcagacacctagatttgaccacctggtggccatagagcgtgccggaagagctgctgatggcaattactacaatgcaaggaagatgaacatcaagcacttggttgaccccattgacgatctttttcttgctgcgaagaagattcctggaatctcatcaactggagtcggtgatggaggcaacgagcttgggatgggtaaagtcaaggaggctgtgaggaggcacatacggcacggggatgtcatcgcctgcgacgtggaggctgactttgccgtcattgctggtgtttctaactggggaggctatgccctggcctgcgcactctacatcctgtactcatgtgctgtccacagtcagtacctgaggaaagcagtcggaccctccagggcacctggagatcaggcctggactcaggccctcccgtcggtcattaaggaagaaaaaatgctgggcatcttggtgcagcacaaagtccggagtggcgtctcgggcatcgtgggcatggaggtggatgggctgcccttccacaacacccacgccgagatgatccagaagctggtggacgtcaccacggcacaggtgtaaccgtccatgttccgtgtgagcagagtccctaccaacgggcaggtctgcatccggggagaatgcagctgcttctggcgacaatcctgctagtaaacactggtcttcggcaacccacgtggtctcctgtgagaatcttctcgacagttacttatggggacacttgtgaacaattaactgccaggcagagcatgagaacaaacattcccaggccatgtaggataggatactccagactccagtcatcctcccccatccatggtttctgttactcatggtttcagttactcatagccaactgcagaccgaaaatactaaatgaaaaatttcagaaataaacaactcttaagttttaaa

SEQ ID NO: 386191 - DNA, 1073 bp, Homo sapiens
gtcgctcaccagtccgcagctcgtgcttgacagtgaggagctgctctcctccgtcgccgccgtccgcgctggtccccgcggcgccgccgctgctgccaccctcctcctccatcttctcctttttttccgatcccgcgggtcgctacgaggggaacccaggagacagcggacgcccgtcccctcgcagccgctgccgcggccccaggagtcggggtgcggcggctccagaactcggacgcaaagacgagtctctttcccgctctggccgcacggctcgctcctcgcctcctcccccttcggcgggcaccgctagtaccgcgcaaccaaaccgccccctgctccaccgccgcctcctcaggccgctccgcccacagccagcaaggagccaagttacaccctgtttaaccctgccttcaaagggacgactctgtaagattctctgctacttattcaagttgacacgatgcccttcacactccacctgaggtcccgccttccctctgccataaggagtttgattctacaaaagaaaccaaacatcagaaatacatccagcatggctggagagctccgaccagccagcctggtggtcctgcccaggtcccttgctccagcttttgaaagattctgccaggtcaacactggtcctctacccctgctgggccagagtgagccagaaaagtggatgctgccccctcaaggtgctatctcagagaccaggtaaaaagcttgggttactgtgggttgaagcttgggagtgtccaggtgctgtagccaggtgtctctgtcatccgggacctctctgtccagcctcagggaccttcacagtgcctggcacagaacctcactcatgactgttgctcaggaacgagctgccctccccactgttctgactccttcccctatcacctggcgcctgtcctggctgagatctttgagatcatggagaaagtccagccctggagaaatcccactggctctgccatctgtccactccatcgcccaagccagaaacccgcctgtacaggattaagaagaaaataaaaaacacttgcattaccaacacccagaga

SEQ ID NO: 386192 - DNA, 431 bp, Homo sapiens
cagatgagttgggcaagatactatagaagtgaataaaacagaacttgttggcaattggatgtaggagttgaggaagaaatcaaagacagaagctcagtcacttaagttgatgttggcaaggattgaaataggaagggacactagtaaagcacctgcaagtagtctgcaatcaataaatatttgtctaattaatggaggtgattattggtttggatttggatgtgttaacttgtatgtggctatggaccatctagatggatgagagccattaaaaatacagaaagatttggggcatccttatggagggggatggtgaacctgtcagaaagttcagagtgtggtgagcagaataaaaggctaggatagagccttgtaaaagccagtatttgtggacttgagggagataggaggaggtagacaggatgctgaga

SEQ ID NO: 386193 - DNA, 349 bp, Homo sapiens
gggtctggtcagggagtgtgtcctcagcttgtctggaggaggcctgcatccctcctgagctcttggaggtgcccaggaaccctgcttctcctcacagggcctggccatatagccagctccaacccaaagccctgcacagtgcctcacccactcccttctcctggtctctcctcaaaagaattttacatgattttaaaataataatagctttcatttacatagtgcttacatttatatagcacttaactatgtgcgatgtactaatttaagtactttatattaactcatataataaatggacacaacacaaaactcaaaaggtacaaaagaataaaacagttaaaaacta

SEQ ID NO: 386194 - DNA, 419 bp, Homo sapiens
atcttgtatagactctgggttcctttataatactcttgtgaatgcatttacttttgttttagcaggcaatcaactcaggtaggctggattatacattgttttgccttttgcaggcagtgattcaaatcccaattcagttatcaaagcaaagcctttgctaaactggtttgggtttgtcctgtgcatgtgtgattcagaggttaaggtgagacccgtgtaggtgcatacataaaagtggagagctccttcacctgctgtttctgctccaggagtttgctctgactccctgtctttctttggctcctttccctgcttgctctgaccagaaagaaaacaattcctatcagagttttagccacctacgtgtgctgcttagtgactgaagctgtcccaccctcaaggaaaaacttgatgagaaa

SEQ ID NO: 386195 - DNA, 483 bp, Homo sapiens
tgcctgttaatgggacataagccaaccagtcataaggctcaaaatcttagcactgttttgactttcctctttgtctgtcctttgtatttaatcagatgtactatatttatattcttcctcaaaacccattacgttgcttcccacagttacctcaaatatcaattacagttcaattgtaactgcttccgatactctaggcattacttgcaataaaaaaaatcttctaaaagcacagctccttttatttcactcttctactttatttcagtggctccccattgcttagtaaagaccaaattcccccagtgaacatcttttcattatctagtcccaaacctacactcttatttgggttccccttcacaaacttgcccagtgattctccaaagaacccccttgggttttctaaaacactttcaggaagtctatgagatcaaaattaatttcataataaaactcagatgttatctatcttttcattct

SEQ ID NO: 386196 - DNA, 550 bp, Homo sapiens
  misc_feature (550)..(550): n is a, c, g, or t
gctcttgcttcttcttcctgggtttgttttgtttttcagagaaacagggaagggaggacattttctaatataattgtttatagggacaaattgttaaaatatgatgtgtgtgcattttgcaagtttgacttgtgtaaaatagattacctctcctgtcttctttccttcccacactgtataccatcctgcctcatgtcaacccaatgaaattgattccattatttttcctctttcttatttccaaacctcataggctatcttgcctatgaacagttgaaagttttgacttctttggactcaattgaattcactaaaacaatgaattttaataatttttttccaaattcttattcccattgcctttaaaagtcctttagaggcaggttgtataatcataatagcctcctctgaactgccttgagttgtttttcttttctgcttttctgtcacttatgtaaagagtacatgtatttacataaaccttctctgtcccggcctatttcaaaataaagtggaaataaaaatctttagctcaatcttaaaaaaaaan

SEQ ID NO: 386197 - DNA, 364 bp, Homo sapiens
tttggtaatacttgccttaatgagttgtcttgctatgtagatatgccaaattgcaacttttaatgtttttttccaccatatgggtagttcttagaataaggacaggcctcaaaaggttgagatttatttttttatgttatataaacttttccttttggattttcctatttatttttcacctctgtttctttttcactgtttctcatacacctcaatcacatcaaaataaatgctttcttgatatctaatactaaagagcttgctggatatttataaaatattctgagtaccatattacatgtttagaattatttttatgttatacaagcagataattaaagcaagtctttgatcccaccaaagc

SEQ ID NO: 386198 - DNA, 1278 bp, Homo sapiens
  misc_feature (5)..(5): n is a, c, g, or t
  misc_feature (8)..(8): n is a, c, g, or t
  misc_feature (11)..(11): n is a, c, g, or t
  misc_feature (15)..(16): n is a, c, g, or t
  misc_feature (18)..(18): n is a, c, g, or t
ccgcntcnccnaccnncnggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgtgagcccagctggggcccaaggcagggactgagggaggaagggtacagctgggggcccctgggcttagctgggacacccggggcttccagcacaggcgtggccaggctcctgtaagcctaacttcctccaacacaggaggaaggagagtgtcccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttcca

SEQ ID NO: 386199 - DNA, 2480 bp, Homo sapiens
  misc_feature (1607)..(1607): n is a, c, g, or t
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggtgagagtggctgccaggtggggggcaagggtggtgggttgancgtcccaggaggaatgaggggaggctgggcaaaaggttggaccagtgcatcacccggcgagccgcatctgggctgacaggtgcagaattggaggtcatttgggggctaccccgttctgtcccgagtatgctctcggccctgctcaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttcca

SEQ ID NO: 386200 - DNA, 3283 bp, Homo sapiens
  misc_feature (1607)..(1607): n is a, c, g, or t
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggtgagagtggctgccaggtggggggcaagggtggtgggttgancgtcccaggaggaatgaggggaggctgggcaaaaggttggaccagtgcatcacccggcgagccgcatctgggctgacaggtgcagaattggaggtcatttgggggctaccccgttctgtcccgagtatgctctcggccctgctcaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgtgagcccagctggggcccaaggcagggactgagggaggaagggtacagctgggggcccctgggcttagctgggacacccggggcttccagcacaggcgtggccaggctcctgtaagcctaacttcctccaacacaggaggaaggagagtgtcccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttccaacttgggtcccctgctcacgccctcgttgggatcatcctcctcagggcaaccccacccctgcctcattcctgcttaccccaccgcctggccgcatttgagacgggtacgttgaggctgagcagatgtcagttacccttgcccataatcccatgtcccccactgacccaactctgactgcccagattggtgacaaggactacattgtcctggcatgtggggaaggggccagaatgggctgactagaggtgtcagtcagccctggatgtggtggagagggcaggactcagcctggaggcccatatttcaggcctaactcagcccaccccacatcagggacagcagtcctgccagcaccatcacaacagtcacctcccttcatatatgacaccccaaaatggaagacaaatcatgtcagggagctatatgccagggctacctcccagggctcagtcggcaggtgccagaacattccctgggaaggccccaggaaaacccaggaccgagccaccgccctcagcctgtcaccttgtgtccaaaattggtgggttcttggtctcactgacttcaagaatgaagccgtggacctcacggtgagtgttacagttctt

SEQ ID NO: 386201 - DNA, 3119 bp, Homo sapiens
  misc_feature (2246)..(2246): n is a, c, g, or t
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgggtggtgggttaaaccacaggctggatcagaagccaggctgagaaggggaagcaggtttgggggacgtcctggggaaggacatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggtgatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggtgagagtggctgccaggtggggggcaagggtggtgggttgancgtcccaggaggaatgaggggaggctgggcaaaaggttggaccagtgcatcacccggcgagccgcatctgggctgacaggtgcagaattggaggtcatttgggggctaccccgttctgtcccgagtatgctctcggccctgctcaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttcca

SEQ ID NO: 386202 - DNA, 3680 bp, Homo sapiens
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgggtggtgggttaaaccacaggctggatcagaagccaggctgagaaggggaagcaggtttgggggacgtcctggggaaggacatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggtgatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttcctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgtgagcccagctggggcccaaggcagggactgagggaggaagggtacagctgggggcccctgggcttagctgggacacccggggcttccagcacaggcgtggccaggctcctgtaagcctaacttcctccaacacaggaggaaggagagtgtcccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttccaacttgggtcccctgctcacgccctcgttgggatcatcctcctcagggcaaccccacccctgcctcattcctgcttaccccaccgcctggccgcatttgagacgggtacgttgaggctgagcagatgtcagttacccttgcccataatcccatgtcccccactgacccaactctgactgcccagattggtgacaaggactacattgtcctggcatgtggggaaggggccagaatgggctgactagaggtgtcagtcagccctggatgtggtggagagggcaggactcagcctggaggcccatatttcaggcctaactcagcccaccccacatcagggacagcagtcctgccagcaccatcacaacagtcacctcccttcatatatgacaccccaaaatggaagacaaatcatgtcagggagctatatgccagggctacctcccagggctcagtcggcaggtgccagaacattccctgggaaggccccaggaaaacccaggaccgagccaccgccctcagcctgtcaccttgtgtccaaaattggtgggttcttggtctcactgacttcaagaatgaagccgtggacctcacggtgagtgttacagttctt

SEQ ID NO: 386203 - DNA, 2877 bp, Homo sapiens
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgggtggtgggttaaaccacaggctggatcagaagccaggctgagaaggggaagcaggtttgggggacgtcctggggaaggacatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggtgatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttcctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttcca

SEQ ID NO: 386204 - DNA, 226 bp, Homo sapiens
ggggagggacttggtgaggtcagtggtaaggacaggcaggccctgggtcttcctggagatggctggggcctgagactggtccaggtgaacgcagagcacaggagggattgagaccccgttctgtctggtgtaggtgctgaatgctgtccccgtcctcctgcatatcccagcgctggctggcaaggtcctacgcttccaaaaggctttcctgacccagctggatgag

SEQ ID NO: 386205 - DNA, 653 bp, Homo sapiens
agaatgttggaggacccagcgcctgcagggagagggggcagtgtgggtgcctctgagaggtgtgactgcgccctgctgtggggtcggagagggtactgtggagcttctcgggcgcaggactagttgacagagtccagctgtgtgccaggcagtgtgtgtcccccgtgtgtttggtggcaggggtcccagcatcctagagtccagtccccactctcaccctgcatctcctgcccagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggtgcctgtggggagcccggctccctgtccccttccgtggagtcttgcaggggtatcacccaggagccaggctcactgacgcccctcccctccccacaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgc

SEQ ID NO: 386206 - DNA, 1658 bp, Homo sapiens
  misc_feature (3)..(3): n is a, c, g, or t
gcngagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttcca

SEQ ID NO: 386207 - DNA, 2900 bp, Homo sapiens
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttccaacttgggtcccctgctcacgccctcgttgggatcatcctcctcagggcaaccccacccctgcctcattcctgcttaccccaccgcctggccgcatttgagacgggtacgttgaggctgagcagatgtcagttacccttgcccataatcccatgtcccccactgacccaactctgactgcccagattggtgacaaggactacattgtcctggcatgtggggaaggggccagaatgggctgactagaggtgtcagtcagccctggatgtggtggagagggcaggactcagcctggaggcccatatttcaggcctaactcagcccaccccacatcagggacagcagtcctgccagcaccatcacaacagtcacctcccttcatatatgacaccccaaaatggaagacaaatcatgtcagggagctatatgccagggctacctcccagggctcagtcggcaggtgccagaacattccctgggaaggccccaggaaaacccaggaccgagccaccgccctcagcctgtcaccttgtgtccaaaattggtgggttcttggtctcactgacttcaagaatgaagccgtggacctcacggtgagtgttacagttctt

SEQ ID NO: 386208 - DNA, 2200 bp, Homo sapiens
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttcca

SEQ ID NO: 386209 - DNA, 3747 bp, Homo sapiens
gaattccttgggcagtatatacaggctctattactcttggtgtttcattcacaaatgttatggctcctgaagtgtgatataaaactttaacttctttggcttgctcccatggatgaggcatgttctctaacaattttaagatcgcgtgcggtaaatactttagggcgcctagaaaagcctttttatcagtattgtacattttggaggccatgtcactgtgagtattaataatctttcgcagatgttccggtggcatctcggctttaggagtatataaattgcttctctttgcctttttggtcattttttttgcatgcttccttgattttcgagtgacgaaagaagcttttcctatgtccagttttctctttccatgtaattctactttcttttctgctttattctctaattcatctagacctggagggggcggtggcggtggtaatgtgaagtccacaatttcttcagcgtttatttcgaagttgcttggaggaggtggtggaggcggaagaaatgtatcctcatttaccgatgatggcaccatcggattatccagttcttcgatctcgtatccaggcggtggtggtggtggtggtggaagtgctaagtcgctgtcctcttcaaaaccaggaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccaggtgagggaggaggtcctggagggcggcagaggtgctgaggatcccctaccagaagcaaacatgggtggtgggttaaaccacaggctggatcagaagccaggctgagaaggggaagcaggtttgggggacgtcctggggaaggacatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggtgatcctggcttgacaagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttcctgggacccagcccagcccccccgagacctgactgaggccttcctggcagagatggagaaggtgcagaattggaggtcatttgggggctaccccgttctgtcccgagtatgctctcggccctgctcaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgtgagcccagctggggcccaaggcagggactgagggaggaagggtacagctgggggcccctgggcttagctgggacacccggggcttccagcacaggcgtggccaggctcctgtaagcctaacttcctccaacacaggaggaaggagagtgtcccctgggtgctgacccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccactcatggtgtcttcagctttcctggtgaccccatccccctatgagctttgtgctgtgccccgctagaatggggtacctagtccccagcctgctccctagccagaggctctaatgtacaataaagcaatgtggtagttccaacttgggtcccctgctcacgccctcgttgggatcatcctcctcagggcaaccccacccctgcctcattcctgcttaccccaccgcctggccgcatttgagacgggtacgttgaggctgagcagatgtcagttacccttgcccataatcccatgtcccccactgacccaactctgactgcccagattggtgacaaggactacattgtcctggcatgtggggaaggggccagaatgggctgactagaggtgtcagtcagccctggatgtggtggagagggcaggactcagcctggaggcccatatttcaggcctaactcagcccaccccacatcagggacagcagtcctgccagcaccatcacaacagtcacctcccttcatatatgacaccccaaaatggaagacaaatcatgtcagggagctatatgccagggctacctcccagggctcagtcggcaggtgccagaacattccctgggaaggccccaggaaaacccaggaccgagccaccgccctcagcctgtcaccttgtgtccaaaattggtgggttcttggtctcactgacttcaagaatgaagccgtggacctcacggtgagtgttacagttctt

SEQ ID NO: 386210 - DNA, 309 bp, Homo sapiens
gcattcttttgatacccacctaataaagacaatctctaaaaccaaataataggctatgaaatgtattgtgagttcttatttcattcaagacagagcttacctttaagtctccagctgagacagttggttttatctttctgaaagcagtttggtcaagtgtttcaagtaaatcaaaagatcggttaatcaattccttagcgaattggattagacactctcatttcaaatggcagttttatgcttactcattgtcttgaataatcttaaatactttatgctatcttcctgctccattatttatgtaatcac

SEQ ID NO: 386211 - DNA, 898 bp, Homo sapiens
ctggctgcaggagttcagtcagcgtggtgggaaatattattaaaattatagaaagaagcacaccttcttggaaggccgggaggttttgcaaaagcttcaggaaaggatttggctgaaggcagctgaattctctcagagtaggttacaaggaagtgtaagggaattgatctagataagttagtttacttaggcctcagaactggcctttaatcatccacatgtaggactgttctggcagcgggggttgggggggaaccgtgttaattactcacacgatgtgctgactcaaagcctttgtcattaaacctgtactaaataaatgcctgaagcaccagcttgtcagggccatggctgctacaactctttctttgagcagcctggtcccctagcccactctttcactggatacctatgtctaagtactttcatctgtcacttggccagggtctatggttcagacccagcacctggcgacagagggagacagcatctcaaaaaaaaaaaaaaaaaaaaaaaaagtatgtttagattgtgggatcagtgattaaagattataaagttcctagaagcagcacaaaataaaaggtagctattactgtttttattatttataataatgtaattgaacttaacagtaagtggcccctgtcagctgccacatggatgggcaggtggcctgaattcttagggatgttggcatcagctccatactccagcaagagagccacagcatctggatttcctccacttgcggcttcaagtaagatggaagaagaatcagaggcctgaccatgagcattagctcctaagaggagaaagactcttgttaatgcaaaaattattttccactgtatttcttgagcaatcttaaaaatatatccccatcaccaaaaaaaaa

SEQ ID NO: 386212 - DNA, 284 bp, Homo sapiens
ctggctgcaggagttcagtcagcgtggtgggaaatattattaaaattatagaaagaagcacaccttcttggaaggccgggaggttttgcaaaagcttcaggaaaggatttggctgaaggcagctgaattctctcagagtaggttacaaggaagtgtaagggaattgatctagataagttagtttacttaggcctcagaactggcctttaatcatccacatgtaggactgttctggcagcgggggttggagtggatggagcagacataagagggtggggatcatg

SEQ ID NO: 386213 - DNA, 528 bp, Homo sapiens
  misc_feature (21)..(21): n is a, c, g, or t
aaaatcttagcaagtgagggnctcaaccctgttcaggagctagaagcctggcctcccagactcaagctatcctcccacctcagcctctccagtagctgagactacaaagaaacaatttagttatgcataggtgacctgagatattagtgccattggttttggtgacaatattttcgaattcaaatagtgtcgtttgtaagttagtttgtatttaaggagataatcgatgaggccaagtatttaaaattggctgggctggtggttcatgcctgtaataccagcactttggaaggctgaggtgggcagatcaccaggtcaagagatcgaaaccatcctggatagcatggtgaaaccccgcctctactaaacgtaaaaaaattacccgggcgtggtggtttgcgcctgtagtcccagccacttgggaggctgaggcaggagaattgcttgaacccgggagacggaggatgcagtaagcagagatggtaccacttcactccagcctggtgacagagtgagactgcgtctcca

SEQ ID NO: 386214 - DNA, 472 bp, Homo sapiens
ttattttaggccaaatagttgcatcacatgtatctaatccgaaagtctcatgcttctggtagctcctcagtgaccagctcctgctcactgccctcagaaagcccaaccctcaggcaatggcggccttgttcctgtctgccccaccccaggtgagtgtctgtcctcctgggaggagtgaagtttttacccagggctttccttggcaaacactgccaggtgtctctggtttgggatgctgacatgatggtaggggtggccctgagacccccatgcagccaccccttgggatgtattagctggctcggtggcagatgggtcaggccacccactgtgctgctgcctttagcatgcttctgctgcctccccgcccctaccagcccactctggaccacacctgggctgcagcagtccctgtcattccaggccgaggtgaccttcgaggacgtggctgtgtacctctcccgggaggaat

SEQ ID NO: 386215 - DNA, 317 bp, Homo sapiens
ctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagctcccctggaatgggcatgagaacatcccccagatggacccccgtaaagcagaggaaaggagagctgattgggctaaggtcgaggcagg

SEQ ID NO: 386216 - DNA, 2843 bp, Homo sapiens
ctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccatcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcataaaaaaaacttcaacctacatccacctgataccacacaaacacaggggggggggccaaaaaatttcccccgagggggccagttttgctcccccctttttttgaaaaggggggcccccaaaggggaggccctattataag

SEQ ID NO: 386217 - DNA, 2801 bp, Homo sapiens
ctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccatcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataagtaagggccttgcagacatgtcctctcaggtgggtggcagtaggagcaggttcttaggacaagaggtgttgctcaccctccttcctttgggttcagtcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcata

SEQ ID NO: 386218 - DNA, 2871 bp, Homo sapiens
ctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccatcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccgtatccttaagatccatcagggctgggacatgactttcaagggtgactgatgacaaggggcccataggtgaggggaacagtcggaagaaacggaccttgtaggctttccttttgttgtctgcccttctgcattggtttgactatccttgactcacgtcaatgccagatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcata

SEQ ID NO: 386219 - DNA, 1235 bp, Homo sapiens
  misc_feature (107)..(107): n is a, c, g, or t
gtacactatctataatggcacgacagatcgatcagagttcacttgcttgcgtgcctgcttagctctgtcacttgttctgcatgttcttacttggaaaacccttcggncccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcata

SEQ ID NO: 386220 - DNA, 327 bp, Homo sapiens
agccgctccagctccccgggaagagacggcatggtgagtttacccttggggaccggggataggctggggaggcagccactgatggagaacagccaggctgagggctcgactcccaacctgactgatgactgacaggctgctcctggtggagacaaacaagagaagtcatcctggcacatctggtgcccctggggctccgtgccgaggggaggggccttcccactctgcctagaaagcccactcagggcccgcgcactcgaggatagtccagtagtgttctcaggaatgctctgctgcgcccaatgaaccactcttctcaccttctcc

SEQ ID NO: 386221 - DNA, 396 bp, Homo sapiens
ggggttaatgatttgggaataatctgatttacttttgaagatgaaggatcaaaattgacagacccttaaacttaagttttgagctttgacccaattgttgtctctctctggttcccagtgatgacgagaaaggccgacagatgtggagaaaatatctagaacgggaagacagtaggatcgggggtaagcgcatgaaagggaagatgcctgttttcactgttgcctgctcttgcctgagtggagcatgaaaagccctaagaatcactctcccggggaagcctgtttctgcctggtgttcaacaaagcaaagcaggaacagcaagaaagaagatgctgtgcaggccgggcatgggtggctcatgcctgtaaacccaacactttgggaggccaaggcgg

SEQ ID NO: 386222 - DNA, 976 bp, Homo sapiens
gcggccgcgctcccctctctccccgtccctgctgctctccaccttcgtggggctcctgctcaacaaagccaagaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcgggggtaagcgcatgaaagggaagatgcctgttttcactgttgcctgctcttgcctgagtggagcatgaaaagccctaagaatcactctcccggggaagcctgtttctgcctggtgttcaacaaagcaaagcaggaacagcaagaaagaagatgctgtgcaggccgggcatgggtggctcatgcctgtaaacccaacactttgggaggccaaggcgggtagatcacctgaggtcaggagttcaagaccagcctggccaacatggcaaaaccccatctctactaaaaatgcaaaaattagccaggcatggtggtgggcacctgtaatcccagctacttgggaggctgaggcaggagaatcactgaacccaggaggcagaggttgttgtgagctgagattgcaccactgcacttcagcctgggggacagagcaaaactccatctca

SEQ ID NO: 386223 - DNA, 2705 bp, Homo sapiens
ctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccatcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcata

SEQ ID NO: 386224 - DNA, 1735 bp, Homo sapiens
gcggccgcgctcccctctctccccgtccctgctgctctccaccttcgtggggctcctgctcaacaaagccaagaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcata

SEQ ID NO: 386225 - DNA, 1946 bp, Homo sapiens
ctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccatcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatatgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcgggggtaagcgcatgaaagggaagatgcctgttttcactgttgcctgctcttgcctgagtggagcatgaaaagccctaagaatcactctcccggggaagcctgtttctgcctggtgttcaacaaagcaaagcaggaacagcaagaaagaagatgctgtgcaggccgggcatgggtggctcatgcctgtaaacccaacactttgggaggccaaggcgggtagatcacctgaggtcaggagttcaagaccagcctggccaacatggcaaaaccccatctctactaaaaatgcaaaaattagccaggcatggtggtgggcacctgtaatcccagctacttgggaggctgaggcaggagaatcactgaacccaggaggcagaggttgttgtgagctgagattgcaccactgcacttcagcctgggggacagagcaaaactccatctca

SEQ ID NO: 386226 - DNA, 324 bp, Homo sapiens
tcccaccccccgcacggcttacaccgagaatggatggcaaagtttaaggccacgaagccgctgcccgtggggaggctccctgaaaggcaggccggccggcctcgggggcacagaaagaagccggcggggggtctcccggtcctgcccgctccgggctgactccccgctctctccgcagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaatttttt

SEQ ID NO: 386227 - DNA, 564 bp, Homo sapiens
gcgaattcactagtgattatccccggttcctgggtaacagagcaagaccccatctctaaaaaaataaaacaaaatacccattacaatagatcttatccacaagcctcattcctcctttcctccctccataaggaaatgaggtaggatgaggtcgccagaagagactcaagccagccttctctgggactctgctgaaaatgctccttggaagcttttggaagttttaatgtcaggtgaccagcttcctggaatttctgtgctgcaagggtggattcatgctgattgggtgcatggatggcaagaacaggcctggaaaacatcgcgtagctcaaactggcatcgattgaggctcattgcctcaaaggaatgaacatcagtaggattcttatgatttcagatttcatgtgctaagtgcacctttactaatacatttaggttcacaactgcttgactcaaataagccaagtatattgtataatatgtgacctcacggtaccctgaagcaaacagatttggggacattgattaaaggcatgttcctcatgtggccttctacttgaccct

SEQ ID NO: 386228 - DNA, 446 bp, Homo sapiens
tgcattcaccatccctcaagttcatgtgaactgatttttcctggacaccagacaaggacccaactacgaagggggcagggtataaaaggctgtcaccctgactctccactaagctggttaacaccttagcagtccacagacagcaactgctaaaagagcattaatggtaacacacccctagatgctgccatggggccagagcccaaaagcgcttgccctggccccagcacctgctcacctatgtactccctcccatgaagggttgagcccagtgggtttgagtgagtgaaatccatccctgctggcaccaaagtggccacttggaccctgagccagtgcactccagttccgcctgcaaaaaggtcaagggaactctctcatctcactaggatttctgtgcattatgatttgggggagcaaaggaattctctgtatcctttggtcat

SEQ ID NO: 386229 - DNA, 350 bp, Homo sapiens
caaaggctacctggtacaaccgtgtgacgggtagacgacagacatgtcacgcgcacacacctgcttatcaaggaaattacaaatctggaaggacatgagcaaaatactaatatttatgagctcacctgtaatccacccacagccaatacacacagtaaatccaagctagacagagcctcggcgatttatttcccctacatcagcaagcttgtccctcttctttattatccatcagaatctcctagatgatttgcgtctttcctttggcttcaagaaggagagttaagacagggacaaatggaagcctcccctcctaatgtatgtcaggggtcagactcagcacaagattc

SEQ ID NO: 386230 - DNA, 446 bp, Homo sapiens
ctttaagacctagccattgcactcagaggacacggactatctagagtactatgtgagagacagtgcagagcatgctgaatgtacagtgtcagggggcattgagtacctaatgacagacatccaacccaaacttacttcaggtaacaatgcaggtggcaaggggatttattggcccaaacaagtaagaatgtcagaataaccttcaggcgtagcttgatccagggacccaacatcagtgccactagtctgtccccatctcttgtctctgctgtcctcgggagtggcttccttctcaggcagtctccttatgtggtggcttccagcaggtctccaattacatcctccaaacttcaggttcagcaggaaaaacaccttatctttttcagtggtcaaaataaacagccactccttgagtcttatgggtctgcctgtgggcatgtgtatta

SEQ ID NO: 386231 - DNA, 202 bp, Homo sapiens
cccaaagtgctgggactacaggcgtgaaccaccacgtccagcctgttcagcctctttctaacattatggtaacaacaattttttttaaaagcatttacaaaaacaatacggtttcttcttcaagagttttacattttgctaataatgtctccctcctatacctgctatcttgtttacttttggataaattttttcttttttt

SEQ ID NO: 386232 - DNA, 291 bp, Homo sapiens
gctaagcaaggggttcacttctgattttggatcaactgggaagaaaactcggttacatatctaaggctcccaaacaaaaagacaaggtttaagacacctgctgctgcttccacaaaataaacataggttataatgcacttaagtcaacacccccaagtaaatttggtacattaatccatattacaaggcagtaaaggccagaaatgctcccaagtttaaacaacatataatcctatttactgtcattcaactgattggactaggtctgattaaaagaaatagaaaactatt

SEQ ID NO: 386233 - DNA, 185 bp, Homo sapiens
aaataaatacacctattatgtacacataaaaattaaaaattaaacaaaacagaaagaaagggaaacttccaccatcagccacaggccctgacactctccttgtcctaaactcttggagctaagaggagctgatgatggactctctgatccccttcctggggtggcacactcttcctttcagaagt

SEQ ID NO: 386234 - DNA, 450 bp, Homo sapiens
aagaaattacatataaaatggtttatactttatgaaaattcggctcgcatcgtcgtttaatggaagtgggtttaacctgattacaacactaacaccagtatcactgatctgatatttacaaaaatttgtatttttcaataaattaaagtcaatgcaacacccatgcaagctagagtgctagctgtttggtgaacaaggacgtgacatcagaacaagaagtctataagtcccaaactttacaagtgtgatcattttcaaactgcatccattcctcgcattgaagatgtgaaacccaaacccattcctctttgtgtgtgggtttgtgatcttgccatttcatactgagcatctaaatttcgaaatacttcttcctgctgcttcagagtcttgtaactttcttcatcaactgagctacatccagcttcatcttcactctaaaaatcagacata

SEQ ID NO: 386235 - DNA, 493 bp, Homo sapiens
cacagctgacctttatccattcctctccctgtattattttatcctgacatttaccatgcacctgctgtgtgttaagcactgtgcttttctatagattcgttcactttacaagaagcagaaatttcagattatccatgggctagaagggttggaagatggtcttaggaaagtctctggcctgtcccagatctgctaaatgtatgggtgtgctacataatctctcagggttcttccagcccaaatttgctaaaattctatgcagctctgagatctagtttctccttctaacagaagccccagtggagcttccaagcctctcttaaccttgagtttctccccagaaagccaagcttgagacaagggcttgagtacagcttttttgaagcgactccaggaaatagaagtggggaaagagcaggaaagaaggaagaaaggaaagaagggagggaagcagagacagagcatgaggaagacaggaagggaggagagcttg

SEQ ID NO: 386236 - DNA, 308 bp, Homo sapiens
tttttggtcctcatttttttctttcccttttggcctctgagactcaacagccctctctgaactcagggacagatgtttctgtggactttctggccacaaataactgtgcaaccccagaacagttatgtgactcctcgatgttcatgtctgtggggaccatgtctgtgggcccccgacacaatcccaataacccccacaggcccttcacaagtactttttaaacactcttaagaaaatgctaaagaagccaggtgcggtggctcatgcatacaaccccagcactttgggaggccaaggtgggaggattg

SEQ ID NO: 386237 - DNA, 434 bp, Homo sapiens
ctttttgccttgaggcctgacggaggtctgactgaagcccccagagctacccaggatatagtcttactaaggctaaagactcctttctctccactacccccagaagatgcagggaaggcatctcttcctcttcagcacttgagaataatagatagcatctaaactcctgaaactggctgacctatttgttagggagctatgtggtcaaaattacgttgaaatgagatgccaatatcagtgtgctgtaaagagtctaaaccacaattattgttgtggctcttagttttggtgattaataataaaccaactccttatgccatggaagagataaagatgcctcacaaaccacaaactagtttgtttgtttatttattgagacagagtctctctctgtcacccaggctggaatgcagtggcataatctcggctcactg

SEQ ID NO: 386238 - DNA, 762 bp, Homo sapiens
attgcttgaacccgggatacagaagttacagtgagccaagatggtgccattgtactccagcctgggcgacgagtgaaactccctctcaaaaaaaaaaaaaaaaagaaagaaaagaaaaatatgaaacaaaaatataaaggggaagaaaaatgctcctcttttattattttctgcctctgatgcttagcctttgttgaggcactgctggttggactagataactacctttcattgttatcttatcaaaagagatttatttactgctcactattttcctctttagaaagatgagctctactttaaagttaaataatgcagaacatggttaggaaaaaaaaagtttgccaatctttttttttttttttttttagaacacattgtattgacttgctgaaattatcatggtggctgctgttgtaaaccaaggaaccatgtaaaaagactggcctctaagccacatttacaaacattgtaaaatttagtgttaactgtttgatcagaaaatagtgctatttttataattcttggaacttatacaaagagagatttagaaacttatcattttaattaatttgtgcacatcttaaatatatatattttgatatcatagatctagatggctgacataataatacagagataatttaaactccctttagtcacttgagaattttaatgcattcattagaaatgtgatgtgagagactattttattaaaaatacatcagataaaaaagtcattgtcttttcaaagcatcaatt

SEQ ID NO: 386239 - DNA, 431 bp, Homo sapiens
ttattatcttgacttcagttacaggatttaccaagaatttgaagtaactgtacctgattctatcacttcttgggtggctactggttttgtgatctctgaggacctgggtcttggactaacaactactccagtggagctccaagccttccaaccatttttcatttttttgaatcttccctactctgttatcagaggtgaagaatttgctttggaaataactatattcaattatttgaaagatgccactgaggttaaggtaatcattgagaaaagtgacaaatttgatattctaatgacttcaaatgaaataaatgccacaggccaccagcagacccttctggttcccagtgaggatggggcaactgttctttttcccatcaggccaacacatctgggagaaattcctatcacagtcacagctctttcaccca

SEQ ID NO: 386240 - DNA, 556 bp, Homo sapiens
gagtgaacaaaaagagacacagtctctaacttcatggagtttatatcctgttcaaaacagagagttaatcaaatacagacacaattgagtatgtatttagaaatctaaattagtgcccctaatgaaacaagttgtagcagaatgcttaacaagggatctgactaaattggtgtattggaagaggcttccctaaagaagggatgctgaagcttcaggtccaattagacaggtgagtgcggagtagggagggcagcatgtgcaaaggttctgtggcaggaatgatggtgtatggtgactgcccatcttggtctaccccaggtagtccctattgtcttggcttattgattaatagcattctcttcctttctccaaagtggcctggtttggaaggtaaattatatggttgactaactgaataaaaagaagctggctggccacagtgtctcacggctctaatcccagcactttgagagacggaggtgggtggatcacaaggtcaggagtttgagaccagactgaccaacatggtgaaactccgtgtctactaaaaaaaaaa

SEQ ID NO: 386241 - DNA, 787 bp, Homo sapiens
cgttaccataagtaacttttttatattgaaaacctgtattttccaaaactgaaaagtggtgagaaaagtaacattgtttcaacttctgcaaatctctttaatatctgccttaacagaatgaagctagatttttcaggtctgcttctgtattcaaacagctgcaatatcatactctggaaaactccacaatatattcatgagagattgagagtgaataagacaaataacatttagtattattaagaaattggttttgacctcatagatccactgaaggattgccagaccacatttaagattttcttggccaggtgtggtagctcacgcctgtaatcctagcactttgggaggctgagacgggcagatcacctgaggccaggagttcgagaccagcctggctaacatggtgaaaccccatttctactaaaaatacaaaaaattagccaggcgtggtggcgcacacctataatcccagctactcaggaggctgaggcagaatgacttgaacccaggaggcggaggttgcagtgaatcaagattgcgccattgcactctaccttgggcaacaaaagcaaaactccgtctcaaaaaaaaaaaaaaattattttccagtggttaaattcctggaaacaagcaacctcccaagattgaactaggaagaaattaaatcctggaatattaaaataacttagagtgtaatttggattgcttgtaactcaaagaataaatgcttgaggggatggatatcccattccccatgatgtatttatttcacattgcatgcctg

SEQ ID NO: 386242 - DNA, 308 bp, Homo sapiens
ttcagtatctaggacagttggcacctggcaacactcatagaatgttagttgaactgctgtgggccctcttcctgaatttctaacttagtttgcaactctatctgtgacttaattgaaccagtatactcccgataacttcactgtcatccttagagatctctgatgtcttcaggaaatgatgatagcattcataaatgctagcattgttgcatatttgttctgtgtcaggcactgtgctactctcttagtttgcatgtcctttataatgttcctgatgactccatgaaatggacactgctgttagtccg

SEQ ID NO: 386243 - DNA, 241 bp, Homo sapiens
ctaggaacaaattgcatattactaagcaatattctgttgaagaagaaatgaaaagaaaaattaaggaattgtttaacccgaataccttgaaaatattgcataccaatttttgtgataacagaaagagcaattatttatagggaaatatgtaactttaaataaatttatcaaaaaactcaaaatattataaacaaataaactaaatatccaactcagagttaaaatacaaagaccaaaaagg

SEQ ID NO: 386244 - DNA, 398 bp, Homo sapiens
aaaaatctttacatagttgaaggttttataatgaggaaaaaaatcagtagcttgcaaggaagctaaaataggttcaatgttgctaaactgatacaagttgtactctaaaaatgcaacaatcattgagaatatctaggacaaccttctttccccttttttttattttagggtagatcctctgttatggtctcactgctaggaacttcttcacattatttcatagaaatcttgtgtagagcatagaaagagttgtgacagggttgttttgaaatatgtgcttactggagccaaactgctaaatttaccagccatctgacatgagaaaaatcatttgatttttgtgtgccttagtttcctcatctttcaatgcagataataatacccattgcaaagattgc

SEQ ID NO: 386245 - DNA, 757 bp, Homo sapiens
agagagtgtatttttgggctgaagcttatgcattttctgtgccatcttgcaattaaaatggaaagtaattatccagttctaaaatgtggatgaactaaaaattatactgtaatatttccccataagacgaagggggtaatagaactacgctgattccatttatttttaatggcccatcaaagatgacaggatttgccattttgtaagaaaccatctgactcatcttgaacttcagtgaatccagtgcctaattctatgtgacatgtctggtggtgccttatatttttgcaaaaataaaatccctctgattaaaatttcacacctagctgaggaccatgaaactctgattacctggtccagtcctggcccagcattgccaaaaggtttacaaacctcagtacaacttgaggggaacttggcctaggcttcaagttagtggaatcattcaaagcccaaggcatttgccaggtggctgtttccctgccctgtgtcagcagctctaaattaggcacatgctctttaaaccagccatgaaaatgattggccaatatagccagaacccaaaggaaatatgatcaggctggccgtgactgaggctaagggcataaaagaagttcatcattcctctcctttgtcattctccatgggtttgaggagagaaagcaaagtttattctctgaaagcagatgctagagttccagtgacattgaaagaaacagaaaaaattgcaaaagcccagatttgcaaatgttggtgt

SEQ ID NO: 386246 - DNA, 210 bp, Homo sapiens
gactgggtggcgtcatcacagacagcgtgtgggaaccgtgcccccaagcgggcccagagggactccctgctgtcttgtaggcactggggatagggtcaggtggaaagcagatacaaatctttgtctttacagggtttcgagttgagggtggggctagaccaacaataaacacgtaagtgtctagtatgttagaagagaggtgctttccag

SEQ ID NO: 386247 - DNA, 211 bp, Homo sapiens
cttgtctccatcttttgctattacaaacaatactgcaatgaataactttatacacatgctatttctcacctatgcaggtgtatctctaggatagattccaaaagtggaatttctaagtcaaaggagggaagcaactctaattgtgatcaatttctgacaaactgttcttcctatggatttcaaaaatttacattcccattagcaatgtatg

SEQ ID NO: 386248 - DNA, 370 bp, Homo sapiens
atgggaggtgctcaaggtacgatatcaagggctgatttaattacacagccattcagtgggacaagcacggcaatttttagccaactgttctagtaaatattacgggaaacccttttatagagtgctaattccggcttagtgttttcgctaagctttagttcttactcaaacatgcacacgggcccccaaagatgctaccaccaggccagaaaatcacacagataaagcatgagcccatatgccatcttgcagtcaatcatccttttaaaaatgttataaatgtctgcatatcactgtcatttaggtggggacaaactaaggtccagtaacttccctgtgtctgttcttcctccgtccccctcccccgtga

SEQ ID NO: 386249 - DNA, 823 bp, Homo sapiens
atgttattgcttcacagtccttctgaatcataaagtgagttctgactgaggttccaggtgatgtagtgaacattccacacagggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaagtaattccaaaggaacatgagcaccaataatgctttaagagtgttttggaaatcaagagaatggaatatgaaaacatcaacatttgattcagatgaggatattctacttttacccaaaagaaaacgttttagaaagaaaaagtcaagaccagtgagacacaccaaacgccatgaagaggagcaggtctatgagcaagggaccacattaccctgttccatatgcaagcacgaaattgacctaactggtatttttctccataagaagcaacatgtagctctggccacgctgggtttccaatggatgggtagaaagaaaccacagccctcagtgattgctgttcagagacagttcatgatttctaaactattgtcatcttttatgttcactgaaaaaaccctacagagcattaataatgcttttgagctgctttggaaaaaacaaataccagcatactataagatttttgataacattgacaggagtgtcatatattctcaaaaaatatgtcatctgttaattaaaggagtgggcatttgtgaagacaggaattctacatggaaagctgacatgaatga

SEQ ID NO: 386250 - DNA, 535 bp, Homo sapiens
atgttattgcttcacagtccttctgaatcataaagtgagttctgactgaggttccaggtgatgtagtgaacattccacacagggagctctaccatcaagtgaggggaatgcccaccatcgctatcatcaccatcaccactacttctgccacagccatcacattcacctctacctccaccatcaccatcactactcaagttggagaaatagaggccaggggaaggggataaagggagggcaaagaaaagtaattccaaaggaacatgagcaccaataatgctttaagtctgagaccgtaggagaaagatggctgtggagtcgcacattacccagaaggaaattaagaaggagcttcagaagctgatcctcacaagcagacaggcccgctgccgccagtaacagccgccgccaccgaatggtcgagttctccggatgaaacataccgtccagcgtgctggcgacctacacttggatagatgcaaccttgaaagaactgagcttagtaaaataagtctatccagaggctagaaagaag

SEQ ID NO: 386251 - DNA, 374 bp, Homo sapiens
aacatcgaggatgcatgttactagatgggcagtcagttgtgcacccgagagataatttgggtgaggtggggtgtgatacattccactgcttggccaagtctgccacctcccatggcaaaggccccacctcataaaattcttcttgggacccaaatacttcctgttcctttaggggaggaaaaagggggcctcttcttcaagagtctttgctgctaatggatatagcagaccctggcttgaaacatgatctgtgtgaggaaccatttccccacactctggcaatttaccaagttagtcagacctggctatgaaattgggctggggggccgggtagccagactgaattgaatgttctccttgttctccctccctct

SEQ ID NO: 386252 - DNA, 473 bp, Homo sapiens
gcccgcctcggactcccaaagtgctgggattacaggcatgagccaccacgcccggctggtggatgttttttaaaccacctaaatgatatcataattttcattctagcttttaaaataatgtatttttaaataatgtgtttttaaagattttgattgcaaaatgaaagaaacaaggataagttgtgctaattccaataaagtatggaggccatggttttagcaacattcctggatctcctcttgcttaagtgtccagctcctggcacacggaaacatcccacattaaatcttccttaggtctgaatcaccccatatctttgactgatgtcttgttttgctaccttcctgatgctgagttcacttttagtgcccatttgttcaccctcacctctattttcagattatattctgtttgccttctctaccatgatacagtgattctatcagataatcataaaacacttccttcagta

SEQ ID NO: 386253 - DNA, 441 bp, Homo sapiens
tttagttaactcttgttttgcttgatattcgtgaatgtttcagcttttcatgagtcctgtactattttcctttattccaaaggttacaatttctaaagctatcataaacctatatttcagagcacctgttacagttctatagcttattagaaaccatcttttgaaaaggattaaaataggacaacaattgtctgtgaatagcaaaatgtccagggtaattacagttagaaacacaattgacaaaaaagtttggttatctccctaatggtttacagtaacttaaaatagcaactaaggactaagctctgatttttatcttgcccagattcctttctaaggagtctggggagtcatgccctacaaaccataaattctcatcagatgggttttatttaaccctgtatattgtgacttactttccaatctgactgtggcataaca

SEQ ID NO: 386254 - DNA, 1839 bp, Homo sapiens
cgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttcaaaaaa

SEQ ID NO: 386255 - DNA, 299 bp, Homo sapiens
attgcagagggttgattgctttaatttgcagagagctttgtcttccaaaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagctgtttcgactctgggcactgtttggactctg

SEQ ID NO: 386256 - DNA, 1782 bp, Homo sapiens
cgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccggtgaggtccggcttgcggacagcgcagcctctaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttcaaaaaa

SEQ ID NO: 386257 - DNA, 1432 bp, Homo sapiens
attgcagagggttgattgctttaatttgcagagagctttgtcttccaaaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttcaaaaaa

SEQ ID NO: 386258 - DNA, 241 bp, Homo sapiens
gcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgcca

SEQ ID NO: 386259 - DNA, 1595 bp, Homo sapiens
ggctggtactggtctgggatgtttgggatctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccgctccggtgccctaccagaactattacgatcgggaggtcaccccgctgaccagcagccctggcatacagccgtcctgcggcatgataaagaggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttcaaaaaa

SEQ ID NO: 386260 - DNA, 1748 bp, Homo sapiens
cgggctgcctgcctgcctgcctgcctggcccggcccgagctccagcctgcctcttccactggccactgcctcccacccagggctggcatccctgctccctgccctgggtcccagactgtgtcctccatcaccgcagggtcggtgaggggctgggctggacaccagggcccgccctcccatcactgagctccactccttcctcattttgctgctgattctagccccaaacaaaacaggttgagctttttcctcccctcagaagctcctctctggctcgtggctgccttctgagtgttgcagacggcgccggccgggaaggggggcctgggccagccctgccaggactgggacgctgctgctggcgcctggccctccatcaggccagcctgtggcaggagagtgagctttgccgcggcagacgcctgaggatgatgccccagctgcagttcaaagatgccttttggtgcagggacttcacagcccacacgggctacgaggtgctgctgcagcggcttctggatggcaggaagatgtgcaaagacatggaggagctactgaggcagagggcccaggcggaggagcggtacgggaaggagctggtgcagatcgcacggaaggcaggtggccagacggagatcaactccctgagggcctcctttgactccttgaagcagcaaatggagaatgtgggcagctcacacatccagctggccctgaccctgcgtgaggagctgcggagtctcgaggagtttcgtgagaggcagaaggagcagaggaagaagtatgaggccgtcatggaccgggtccagaagagcaagctgtcgctctacaagaaggccatggagtccaagaagacatacgagcagaagtgccgggacgcggacgacgcggagcaggccttcgagcgcattagcgccaacggccaccagaagcaggtggagaagagtcagaacaaagccaggcagtgcaaggactcggccaccgaggcagagcgggtatacaggcagagcattgcgcagctggagaaggtccgggctgagtgggagcaggagcaccggaccacctgtgaggcctttcagctgcaagagtttgaccggctgaccattctccgcaacgccctgtgggtgcacagcaaccagctctccatgcagtgtgtcaaggatgatgagctctacgaggaagtgcggctgacgctggaaggctgcagcatagacgccgacatcgacagtttcatccaggccaagagcacgggcacagagccccccggttctctggactgctgcacggaagtcccaagaccacttcgttggcagcttctgctgcgtccacagagaccctgacccccacccccgagcggaatgagggtgtctacacagccatcgcagtgcaggagatacagggaaacccggcctcaccagcccaggagtaccgggcgctctacgattatacagcgcagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttcaaaaaa

SEQ ID NO: 386261 - DNA, 384 bp, Homo sapiens
gttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaagggggaggggtctatgtctcaccctgctcttagcgtccacagagaccctgacccccacccccgagcggaatgagggtgtctacacagccatcgcagtgcaggagatacagggaaacccggc

SEQ ID NO: 386262 - DNA, 167 bp, Homo sapiens
gaggcaagatagctggttttgtccctcctgacaaaggtttcctcctccttctagacgacctgagtctgttagccagctccaagacgcccttctccttggtagaaccccaccgagtctgatttgggtggcaagttagagcttggtctacgcctggggtttctaaagcc

SEQ ID NO: 386263 - DNA, 491 bp, Homo sapiens
gaattccccaaccctgtgtgcttcctgggtgaagcgatgccccaccctgctttggcttgccctctgtgggctgcacccactgtctaaccagtcccaatgagatgagccaggtacctctgttggaaatgcagaaatcacctgccttctggattgatcttgctgggagctgcagacgggagctgttcctattcggccatcttgccagccagggtcattttttaaacttttcttttgcagaggttaccaaaggaccagcagcaagcaaaacttctctcccctccccaaaaatctttctttccattgattctattttgtttcaatccagtcctgattgtgagaaagctccctctcaggacagctctcctggttctcttcaggctgataatggaactctggtatgatggaagggtatgaaagtctttttctaaatgctgtatgtcttgccttttttgtatatttgtgtaaagaaattcatagtagtaattctctga

SEQ ID NO: 386264 - DNA, 596 bp, Homo sapiens
cgtggagatggggtttcaccgtgttggtcaggctggtctcgaaatcctgacctctagcgatccgccctcctcttttggggattacaggtgtgagccacctcgcccagccaggcttcacattattaagtagccatctcttaagtattttttaaatctcaagtacccaaggctgatggccaatgagtgcttcttttatgacatttgggataggtcagaggtttgttgtaagtctcttgcaaaaatgcctggaggccttttcaaggtctgtaaaccttaactggaaataatcctattattattttaaaaattcctcatgtctgaaagctttcagtgcacctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtc

SEQ ID NO: 386265 - DNA, 502 bp, Homo sapiens
ccactgcgcccggcctcttcatcctctttctactctcctatatttggatgatcagtttctctttttggattttatttatttaagcatctctatgtcttctgggatggggtcaaagaggatgggtcatcttcagatttactgagcaaatttccaaattcgtgagtttccagatgaaaagagtgaagaacgccgtgtggagtcaagaggttcaagtcacctccctagttgggcagcccttggtgagcaacctgagccacctttcccattggcatgcctcctgtgcacatgcatgcacacgatttggggaaagaacgtgaagaggaaataacccgaaggtgggctgggcgtgctggccctgactttttgttcacataacgttttcaaggttcctcgaagttgtagtatatatcagaactttgttcctttttatggctgaataatattccgttttctagatataccaccttttgcttaattcatatttaaaatgaagcaatttctc

SEQ ID NO: 386266 - DNA, 364 bp, Homo sapiens
caatctcagtgaatgacattccttcttttcagttatacaagttggaatgtaaagggaattgacatagacttttctctgtctcctaccctgcaggtccatctagcccgaggtagtatcagttcttgtgcatctacctttttgacgtgacttgtaatcataccctcctctttattctcactgctactgacatagttaagaactttatcttgactgttattgccattatagtgacagtctaactcactgcttctcacattatctgagctgaagaaccagggtttattgtttctgtttttttaatttttaatctgttgcagaaattttgtagcatataaaaaaattaattagaaaaatgaaatgaaaa

SEQ ID NO: 386267 - DNA, 4401 bp, Homo sapiens
ataccttaaatgccgcgagactgaagagcaaacgtcagggattattatgtcgattttccgaggaccagggttcgcagctggcagtagaagaaaaggctggctcctcaggggtcccactggcatttgataccctgaacgaccctcaggattgcccaaattcggtggatcgcccaaattcggtggatcagcaactttcctatactgcatcccgaattttcaaagaacatattttccgttcacccccgctggtcttttactgccatcaatacactgttcttggtgcaaatacctcagcctctttattcaaagtatgttttatgtttttgccaaatatgatctctaattgaaagtttatttttggttttggatgaatctgcggagcttaagttgtgagaagaaagggggaacaagacacaatgaaagaaaagtccaaaaatgctgcgcggactaggagggagaaggaaaacagcgaattttatgaactggctaaattactgcctttggcctcggctatcacctcgcaggtggacaaagcatccataatcagactcacgaccagctatctcaaaatgagagtggtgttcccagaagggctcggcgaggcgtggggccactcaagtcggaccagccccctggacaacgttggccgagaactgggctcccatctgctccagaccctggatggcttcatcttcgtggtagccccagatgggaagatcatgtacatctcagagacagcctcagtccacttgggtctttctcaggtagagctgaccggaaacagcatttatgaatacattcacccggcagaccacgacgagatgacggcggtgctcaccgcccatcaaccctaccactctcacttcgtgcaggagtatgagatcgagcgctccttcttcctgaggatgaagtgcgtcttggccaagcgtaacgccggcctcacctgtggcggctacaaggtcatccactgcagcggctacttgaagatccgccagtacagcctggacatgtcccccttcgacggctgctaccaaaacgtgggcctggtggccgtgggccactcgctgcctcccagcgccgtcacggagatcaagctacacagcaatatgtttatgttccgcgccagcctggacatgaagctcatctttctggactccagggtggcggagctgacggggtacgaacctcaggacctgattgagaagactctgtaccaccatgtgcacggctgcgacaccttccacctgcgctgcgcgcaccatttgctgctggtgaagggacaggtgaccaccaagtactacaggttcctggcgaaacacggcggctgggtatgggtgcaaagctacgcgaccatcgtgcacaacagtcgctcctccaggccacactgtatcgtcagcgtcaactatgtcctcacagacacagaatacaaagggctgcagctctccctggatcagatctcagcctccaaaccagccttctcctataccagcagctccacccccaccatgactgacaacagaaagggggccaaatcccggctctccagctcaaagtcaaaatccaggacttccccataccctcagtattcgggatttcacacagaaagatcggaatctgatcatgacagccagtggggcggaagtcccttgaccgacacggcctctccgcagcttctggaccccgccgataggcctggctcccagcacgacgcatcgtgcgcctacagacagttttcggaccgcagctctctctgctatggctttgcgcttgaccactcgaggctggtggaagagaggcatttccatacccaggcctgtgaaggaggccgatgtgaggcaggcaggtacttcctgggaacgccgcaggccgggagggagccctggtggggctctcgcgcagccttgcccctgacaaaggcctccccagaaagcagagaagcctatgaaaacagcatgcctcacatcgcttcagtccacaggatccatgggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgacttgaaaaatattcatgtagatcaagtgtgcatatatactacatgagaggactgatgaatgacaacattgcattgtgactatccagtgatcctcaaacacacaaactattacttacaaactgcggtatacattttacatatggaaatataggctatgtaatgtaaatacatcaaaaatgggtaattttctttgactctgtcacactaaacttcttaacgaaatttccattcccaaaataactgagaaagagagagatacatcttataaactgacttctttgtggtttcaaatcagccagctcatttggttcaggcataaattagagaaatggttctggatatggtgcaaaaatgagttttcacctggtatccattataaacaatcaggaagaggtaatttttcaccttgcttttcagttagacaaggaccaggattgcactgacatggcgctgagggtttttctaagtaagaacactgagatattgggacacacatcaaaaacctggagtgctcaattggaagtagttctatgaatatggaaaggccagaggcagagtgaaataaaatgctatctcaaagtttaacacaatttaagggctcagcataagtaaacaacatatttggggtttgcttgtaaaaccaactaaataaaaaattcaaaccaattcacccagaaaaaagaccaataggtgcaaaaataaaaggaaaaccagtgaagtgccacatgacagcagtgttaagtgtttgaaaacgtttcaaagcacatatgtgccaatgtgacaacatgtggaaagcctcaggagagagtctaagataaaagcttaggctgatagacaagtagttaagagctaagagcagtactctgaaggaataggcaaaatgtttattttccttattgtttgtaaacaacaaacttggtcttacatctgtgtggtatagtagaaaggccagctgactagatctctggattctaattttggccctacctgtaacttaattttgtgaccacagttgtaccattcaccgtgcctgggctctagtttcctggtttgtaaggcagccccagcgttcatgttctgtgatagagcagaactgaacttattacctaattaactctctgctatgagttgtcaagactgatcattctgttttttctgtacacagaagtttagatgctttgtgacttaagcaggtgtgtgggctcctttaggcaggttacagttaactttctagatttagccaaaatgtagttggtagaaatttatgacagagaagaaaaatagcaagatttatttaatgctctattctctagtaattaaagcaaaatgatataagtgattagagagatttcatagataatatttcctaggagtcccgtgcccaaaactcttgccatatttaaggaagggaatgtactggcagaacttgact

SEQ ID NO: 386268 - DNA, 405 bp, Homo sapiens
aataatcacatcagacccaatccaaacattttgttttgctgctataggtatatttctaatgcaacaactggttaacctgctgaagggagtgcttcaaatagattcttctagtgcgtacttgatctgtgctcccagagggcaaagaaagggaaagagaccttggagaattctcacagagacttgcaagcaaaagcagctatttcagtcagtgacttctctttttatgaaagaaacattccgtaaattacaattagggcctggccagaaagaagagctccctaagagagaaactttctcatacctttgctgggctcatcttcacgtccctggatgaatccctggatatccagatctcaccttgggcacctttctggagaggatcaggaggctgtcatttggttctta

SEQ ID NO: 386269 - DNA, 255 bp, Homo sapiens
aaacccagcaataatggcccattgatcttcaacaagggtgccaagacaattctgtggaaaaagaacagttttcaacagatagtgctgatacaactggatatgcacacagaaaaactgaaggtggaccagatggctcaaagacctaaatgtcagagcaaaagctattaatgtacaacctttagaagaagacagaggcaaatctttatgaccttggattaggcagtggcctgagatatgactccaaaagcacaaaca

SEQ ID NO: 386270 - DNA, 474 bp, Homo sapiens
agtgaagcctaaagtaagaagaaagaagaaaataataacaaaaagaaaattaatgaagttgaattggattctttgaaaagattaatatgctagacaaacatatcaagtaatataaatataatatataaaattataaaattttaatataatagaaaatcaaaggagagagaaaacataaattaatgttaagaataaaaggggccgggcgcggtggctcacgcctgtaatcccagcactttgggaggccgaggtgggcgaatcacgaggtcaggagatcgagatcatcctggctaacatggtgaaaccccgtctctactaaaaatacaaaaaattagccaggtgtggtggcgggcgcctgtagtcccagctactccggaggctgaggcaggagaatggcgtgaccccgggaggcggagcttgcagtgagccgagatcgtgcactccagcctgggtgacacagcaagactccatctc

SEQ ID NO: 386271 - DNA, 494 bp, Homo sapiens
cctgaccccggagaaccactgactttttttttttactggctttatagttttccctttcccagaatgtcatatatttggaatcacatgcatgtagcctttttatactggcttctttgacttagcaatatgtatttaagttccctccatgtcatttcttggcttgttagcttatttctttttattgctgaataattccaagccacagcttattggtctgtttatctattaaaggacatcttggttgctttcaagttttggaaattgtgactatgattgctagacatttgtgggcaggtttttgtatggacataagttttcaactcatttggataaagtacagtttctggatcatatgataagactatgtttagctttgcaagaaactgtcagactgttttccaaagggctgtacaattttgcactttcatcaaaaatgagagttcctgttgcgccatattcttaccctcaggttttgccagtgttttggattttag

SEQ ID NO: 386272 - DNA, 341 bp, Homo sapiens
gcagcctaggtaaagctatagaatgcacttgttgcttgctgcttttgtgcaaaaaaaaaaaaatgttagatttgtgtctggctctgcagctcagtcagagtaaggctgatggccgctgtctcacagggaacaagagggttggtgagagaacctgagggcgccagcacacccagtggcccatgtgaatgcccatgcatttgttgactgcctgctatgagccagccctgttgagggctttacccctcacatgaccttgtgaccctgtgaggcaggtcccgttattccctccattttccagacaatgcagagagacatgaaatgggttattgggttttaaagac

SEQ ID NO: 386273 - DNA, 414 bp, Homo sapiens
atttggttatcgttaacactaaagccaaaaaaggaattggaagagagccacttaaaaacccaaaggccttctccgcggcggctgccgccgcccttctcttgctctccgtgtctcccttagttttgggcgcaggagagccctgggctctacacgggcctgcaggcggcggcaaggacactacggccttagccctcttagggaggccgctgcagccccaccggaagacatgtgaggaattgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctgg

SEQ ID NO: 386274 - DNA, 516 bp, Homo sapiens
  misc_feature (23)..(23): n is a, c, g, or t
gtggtgtctagaggatccctatnatgttgacgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtca

SEQ ID NO: 386275 - DNA, 830 bp, Homo sapiens
  misc_feature (716)..(716): n is a, c, g, or t
  misc_feature (727)..(727): n is a, c, g, or t
  misc_feature (732)..(732): n is a, c, g, or t
  misc_feature (734)..(735): n is a, c, g, or t
  misc_feature (739)..(739): n is a, c, g, or t
  misc_feature (743)..(743): n is a, c, g, or t
aggccaagcggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcaaaaaaaaacaaaaaaaaaaaaaatttggggggggcgccnggcccaaaaanttttnanncccnttcngtgggggcggggcccactgggaagggcacctgggcccagagggcccagggaaaccgggccggacacgggggggtttctcccaaaaaa

SEQ ID NO: 386276 - DNA, 1265 bp, Homo sapiens
aggccaagcggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactga

SEQ ID NO: 386277 - DNA, 1728 bp, Homo sapiens
aggccaagcggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgaaaaaaaaaaaaaaaaaaaaaaaaaaaaaaaaaaaaaaaaaaaaaccgggggggcttattatgaggggggcggcggaaaacaaggcggttaatagtaatggcgcagccgtggcacaacggtggtttcctcgtcacccacattttttgtcacaagcgggggaaaaacgggggggggggccccccccaaaggagaggggggggcgccaattaaacttagccgaaacaacccgggggatttgccgcgcggttttaagatatttggtgctaaaaatacaggcgcatatatacacgggcacaactacgaccgacgacgactctaactatagtgctgacgaacgacgaacctacctagagaacaccagcgactgacagtacgaagatcaaccgcgagactaataacaacaaaacccgcacgcaccactcggtggtgatggagaggaacgaacactagagacgctgcgcta

SEQ ID NO: 386278 - DNA, 1074 bp, Homo sapiens
  misc_feature (23)..(23): n is a, c, g, or t
gtggtgtctagaggatccctatnatgttgacgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactga

SEQ ID NO: 386279 - DNA, 927 bp, Homo sapiens
aggccaagcggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcaaaaaaaaaacaaaccgaatcaacaaaaaaaaccggttggggcgcgcctgcaccaggaaagaggtttctaaacccatgcgttgggggcggggcgccagtaggctcagtgacacctggcccacgcgtcccaaggagacccgggccacacaggtcggtggtttcccacaatataaaagcccggcggacccgacggtttgacacacccagaggggtggagccatcggctcccagggaccgggagcgataagcag

SEQ ID NO: 386280 - DNA, 541 bp, Homo sapiens
  misc_feature (1)..(1): n is a, c, g, or t
naaactaggctaggtacgaggctgggtggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactga

SEQ ID NO: 386281 - DNA, 603 bp, Homo sapiens
  misc_feature (1)..(1): n is a, c, g, or t
naaactaggctaggtacgaggctgggtggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactggtgagaggtagcggcttacgtggggacccggaggccgccgctcaaggtcgtagccggcccggccggggtttctcatgggcccagctgaggtcaccaacttgggcagaggcgactgcgggtgcttcaggggaagagggtcacccgagcctaccatgggccggacctggcggcggcgcggtggtcagaccggccgtgcctagcattcgtacgtgctatcggagctttggtctcttttgtccttcgcaattggcgggaggacgatgactgtcagtgacacactcactttgtgggtgaggcagcggaggcaccgagaggtgaagtgatgtgcccagggcccaagccgagccactggtgtacccagaacccaaagtctagagttgcagaatgtaattatagatgcccgttggatttttttgtttgtgacagagtct

SEQ ID NO: 386282 - DNA, 541 bp, Homo sapiens
  misc_feature (7)..(8): n is a, c, g, or t
cacgccnnagcgttatcgaattcccggcccttcatacgctgcgagagacgccagaagggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtca

SEQ ID NO: 386283 - DNA, 489 bp, Homo sapiens
  misc_feature (1)..(1): n is a, c, g, or t
naaactaggctaggtacgaggctgggtggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtca

SEQ ID NO: 386284 - DNA, 1077 bp, Homo sapiens
  misc_feature (1)..(1): n is a, c, g, or t
naaactaggctaggtacgaggctgggtggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactga

SEQ ID NO: 386285 - DNA, 891 bp, Homo sapiens
aggccaagcggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcaaaaaaaaaaaaacaaaaaaaaaaaaaaaaaaaaaaaaaaaaaaagacgcggggggctttatttgggggggggggaaaaaggggttataaaaaaggggcaatgtggggaaggggtgtgttcggggccccttttttttggacaggggggaaaagggggggccccaaaagggggggggaagaatgagaagggcggggttcccggtagttttttggaa

SEQ ID NO: 386286 - DNA, 1050 bp, Homo sapiens
  misc_feature (23)..(23): n is a, c, g, or t
gtggtgtctagaggatccctatnatgttgacgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtggaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactga

SEQ ID NO: 386287 - DNA, 1140 bp, Homo sapiens
aggccaagcggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtgggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcaaaaaaaaaaaaaaaaaaaaaaaaaaaaaaaaaaaaaaaaaaaaaccgggggggcttattatgaggggggcggcggaaaacaaggcggttaatagtaatggcgcagccgtggcacaacggtggtttcctcgtcacccacattttttgtcacaagcgggggaaaaacgggggggggggccccccccaaaggagaggggggggcgccaattaaacttagccgaaacaacccgggggatttgccgcgcggttttaagatatttggtgctaaaaatacaggcgcatatatacacgggcacaactacgaccgacgacgactctaactatagtgctgacgaacgacgaacctacctagagaacaccagcgactgacagtacgaagatcaaccgcgagactaataacaacaaaacccgcacgcaccactcggtggtgatggagaggaacgaacactagagacgctgcgcta

SEQ ID NO: 386288 - DNA, 554 bp, Homo sapiens
  misc_feature (1)..(1): n is a, c, g, or t
naaactaggctaggtacgaggctgggtggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactaaaatgggacgggataaagtccgagaaatgtttatgaagaatgcccatgtcacagaccccagggtggttgatcttctggtcattaagggaaagatcgaactggaagaaacaattaaagtatggaagcagcggtaaaagcttaagcttataccgccttcagagaaatgtctactcaatcgctttttcaattttttgattgggctatttggtatattgttgagttttagcagttctcaatatattctggatattattctcttaaccggcatataagcaaatcgattctcctattctgtggacgccattttgacttcgtgtacgctgtgctgtttgacgtacaaaatggttccgggatatctaaggagtccaattgtactagtggc

SEQ ID NO: 386289 - DNA, 810 bp, Homo sapiens
attctaaccctcctgtctgccagctctgatccagaactttgcatgactgatacggctgatagattgtctatggctgatagactgtcatttctgacctaaaagtctgatcattttacatctgttcagacatctttgcagcctttcggtgtcagttccaaagttgttagtgggaatttcaaagcctttaataatctagccccactttgttcactctctgtgtaataaccacatacaacaattggctgcatctccatagcacatggtactcctcccgttgtcttggttgtgccagcaacactggttttcgctttctcttcctgcttgttgaggtcatttccaaggcccaggtctttgtgctttttcccaagcttcccagagcttcttccatactccccttacttcctgagatttaactgttctctcttcagcgcttgtctagtaagaaggaggcagcagcagcactgtggggtggtggaaagtgtaccagctttagagtcagaccattggatctcagccctaccattttctacttagatttttttaggacaaatttctccatctttctaagcctccaattgctcacttacaaaattgatataacatttaccttgcaagattggtatggaaggtaattaacccagtatttagaacatagtaattaataaataactattattaccatcattactatagttaggacactcactgttaggtgctatacaaagaggatcataaaagggatgttgtcttgggcttcttggaataaatgttgtccttttactgtattttagaatatcattctgggtcata

SEQ ID NO: 386290 - DNA, 1525 bp, Homo sapiens
aaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataaccatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaaggaagaatgaatgtgttagcttcacatcttaaaagtttctcctatttgtgtctgtctaaataggtgcagacactaaggatagtgaggatggaggctgggatgaggaaagggttcatcagaattcacatatctgaattcactggaaagagcccttctgaagcaaacagttgtaaaatcactgcaaggtttttattaataatagacatgtatatgattttcagtctatagcatctttgttaacatctgccttttgcaggaaatgtaaaagttatttaacactacaagaattttaacaatagttgctctatttttgaatatgtattaaatatggagttcatatacctgctaatatcaacggtggtgctcttactattagttaattgcattttggttaaaa

SEQ ID NO: 386291 - DNA, 201 bp, Homo sapiens
acttcctgtgaagcagagcctccacaaattgacgcataaaacgcaggactcttcccgcttggattcgcgaaggtcttgaaaaaatggaacgtgaaaagcagaagaaattggagaaagaaacaaattcgctcataacaaatattgtctgagtacataccataggtcatgtgtttgccaagtgctatagatataatacagaat

SEQ ID NO: 386292 - DNA, 499 bp, Homo sapiens
tgttagccaggatggtcttgatctcctgaccttgtgatccgcctgcctcagcctcccaaagtgctgggattacaggtgtgagccactgcgcccggcctagatgaagttttaaaggctctccattctctttctcgctggagttcacactttggtattcttaatgataattatattcgtctgtgtctcttccctagcttctttggaacatctcagggccttttgagttctaactactcttcttgttttatgtgggctctatctaatacctctagattaattcagaacatatttaatccttcttgtataatagccttcacatgtgtgaaagcttcttgatctctttcccagtcttaaaaactctccagcaacttcatccttccctcaccaaaatgcaaatttccttctgcttgaaccgtgatgtttaagttccctttcatagtggagtatccagaagggaacacattgtagctagcttgttgtgggttaagactgtcacttt

SEQ ID NO: 386293 - DNA, 164 bp, Homo sapiens
agaggacaattgaatgcaatgtcatattttataagttctaagtgacacaaatattaaattatcttaaaaattaaatgccaggttctatttcatacaaactgaactctgttttatgtttgactacaatgtgaagagacatgaggtagacaaaaaagggaggacca

SEQ ID NO: 386294 - DNA, 827 bp, Homo sapiens
aggcgaccgtgcaggaagaccagaaggaaagtaatctgccgcatccagaatgaacagaacaaaacccccgcactccaggaagaagtcaggagcccagtgggggctgcaggtccagcccacaacaacctagacatgtggggtgctccatggctcacgcttatgtcctgcaggctgaagcccgcgccaggtccgcagtctttgttccggacgcagaaccagtgcttcagctggttaccgaggcgtccccgaaggggaaagggtggacacggtgagaatctacagcacagcagatcacttcgtcctggcagcgaccagccctgcccgagcggcaccagcagcctccatgttagaggcagtaccatcagacttcccccctacagcatctctcctgctttttttttccctcacggctctaatctcctgcttttgttcatcctccttgtcacagtggggcacctggcactatagagactcagaaaatccgcagatgtggggggtcctgcagcatccaggcagacatgccggcagtcagagaggaaagtcctctgaagcctctagaaggaatggaacaggacccagcactgcaggaagaagtggggcacccagtggcggatgcaggccccacacaccgccgcggtaaacgtataaggctttccctggcccttgcctgtttcctagaagctgaagccgcgcggaggcccaggttcgcccttccacacacggaataagctgttggactggctgcctcacctaggacccgagttgcgccagagaaaatcgcggatgctgctttcccgcgggctgcagtgtctgtcactttagcgacc

SEQ ID NO: 386295 - DNA, 507 bp, Homo sapiens
tgttctcaaacaaaatagtaggcattacacgaaaatgattctgtgatcaaatacttttggggaatgctgcctttcataatgtacataatagtttaattctttttttggagatggggtcttgccatgttgcccaaagtaaacttgaactctcacctcagcttctcaaagtgttgcgattataagtgtgagccactgcacccagcccttaatagtctaggtttctgagagatgtgttccgcagtaatttgcaaaatgtgtaaaaatgtatttgaccatggaccccttttctgtgatgaatcttgaactggtatccctggaacagattttgggagaagttgggctagagcataagatgagtacaaggagctgataggaaatcaagttgggaaaaaagctggtggctggctcgtggagggccttgtatattatgttaagcaaacaattagctttttcctttagatggtgggaaaactttgaggaattttaagctattgagtaagatgatta

SEQ ID NO: 386296 - DNA, 490 bp, Homo sapiens
ccatgttggccaggttgctcttgaactcctgacttcaaatgacccacctgcctcggcctcccaaagtgctaggattacaggtgtgagctaccactcctggcctgttttttttgttgttgtttgtctgtttttttttttaagaaaaagattaccagtgctcactttaaataaacccattactactagagcagttgtgacagaaacagaaaaaacacacattttttaggcttttaaaatagaggcatatagaaaagtaagtagaaaatggttcataattctagtgtccagattacctttgttaaacttaaacaataaaattgaaaaagtaatacacattaagttggtcagaagtgcacataaagatttaaaaaacacatttctagaaatctaaaaaaaggaaagctgcctttttccaaatctctctcagcaaagataaccaccactgacagcttattgtggtttattgtggtttcttctaaaaaagagaaaa

SEQ ID NO: 386297 - DNA, 192 bp, Homo sapiens
gtgactgagcctccagaagtaatgcaggacactgggaggcagggggcatccaggcactcagggccctgacctgggctgctgcacactggggctaaggggaaaggaggggagaggctgaggaggaggctcccggggcgatattccaaggcagggggttccggggccctggggctgaagggcgccgaccctatg

SEQ ID NO: 386298 - DNA, 516 bp, Homo sapiens
cacagattctcctctgtgccatgtggacattgccatcccatgcaacaacaagggagctcactccgtgggtttgatgtggatgctggctcgggaagttctgcgcgtgcgtggcaccatttcccgtgaacatccatgggaggtcatgcctgaactctacttctacagagatcctgaagtgattaaaaaagaagagcaggctgctactgaaaaggcagtgaccaaggaggaatttcagtgtgaatggactgctccagctcctgagttcactgctactcagcctgaggttgcacactgatctgaaggcatgcaggtgccttctgtgcctcttcagcagttcccttctgaagactggagcactcagcctgccatagaagactggtctgcagctcccactgctcaggccactgaatgggtaggagcaaccactggaaggtcttaagctgttcttgcacgggttcttaagcaacatggaaaataaacatcagtatctaaataaaaaaaattttaaaaattaca

SEQ ID NO: 386299 - DNA, 370 bp, Homo sapiens
tggggctatgtatacagcctttgtgaccagtgtgaactatcacttttggttgtgctgagcagtcggttgaattgagcagaacaataaaacccaagtgatggacatttctgagatgctgccagttgcacatctgaactgaccagtttgtatgtactgttggcctcaactagattgacttgatgttgcttttgctaggaaacacataagaagtcaaaacctcttcagcatttttattgctgttcatgttaaagagaatttttttttttttttttttgagacagggtctcactgtcattgcccaggctggagtgcagtggtgcaatctcggctcactgcagccttgacttcccaagctcaggtgatcctccca

SEQ ID NO: 386300 - DNA, 217 bp, Homo sapiens
gggttagggggaacagggagaatggagacttattgtttaatgaatatagtgtttcagttttgcaaagtgaaaagaattctggagttggatggtggtcatgattgcacaacaatattgatgtgcttaataccattgaactgtatatggtacttaaaaatggctaagatactgtagtacatttgtattatgtgtattttaccacaattaaaaaaaatgg

SEQ ID NO: 386301 - DNA, 106 bp, Homo sapiens
tgcagctgccatggtgttgcttgctgctgtcaaggccaaagctcatgtgaagtgtatgttactccagtgatctgtatatagctgcttaaccttaaaaacaaacaga

SEQ ID NO: 386302 - DNA, 230 bp, Homo sapiens
tattgtgggtatgagaaggaaaatatatcacgaattgacataccttctaatattataacaaaatgcaaattcctcattagttatttggaaatggtttcatagattacagatagttatattaacataaaattttaattaatattctttaatagaatatcatagaaatatttaaaacttttaactgccaaataacttgaagatgtataaaactccctccaataagatccttt

SEQ ID NO: 386303 - DNA, 326 bp, Homo sapiens
tcgcagggctctgaggggagcaggctgaaggggcgggagtgggactccttggtggtggtagtgaagctgcaagacagggaacagggtcagggccgagggcaggaggaggcctgagcggccacaacgggaaaatggccatgagggcttggccacagtggggaatccacagcccaacgctggggctgctctcgtagcctaggatgggacccccatcctgtcccacctctcaagtctggaggcttctcccagaactggaaggttcctgggataccctccatcagagcgcccttcccactctattggaccggagccttccatttttctct

SEQ ID NO: 386304 - DNA, 233 bp, Homo sapiens
cccagggtcactgttacaatgtctataagaggacctgtagcttctatgtgaatgatcctccttcccccacctcaggcaggcagggggtctcttgaaaactcccagtgaaagtgtttgagcctctcttgtcaccctaaattcccttgtagttgaaaatattttgctggtctaatctcacatattctagttctgttgctatccccagtggaacaaaaggaaacagttctgagact

SEQ ID NO: 386305 - DNA, 467 bp, Homo sapiens
cactgcgcctgggtttaattccttttgacttaactaaatgcatgacatacagcatatttcagggcggtgacttaaagtcaacaagcaggatgtttactgaatacatgagagaatgttgatttttgtggaggaaaatgttgcctcagagagaggtaactgggattcagtagcaagctcccagggactgggagtcaggaaacctggagtccaatccatgctctaccactttctagttctcacacctccttgaacctcaggtttctcacctgtaaaatgaatataaaaaccacctctgcacctccagcctcacaggttgatgtgttggtaccttgcgattcctaaagtgttactgaaaggaagattttctttttgttaattaaatacctccaagcagcaggctaaaaacaagaagataattttctgcttttaaaagaaaactagacagagacataaggtaggctgttcca

SEQ ID NO: 386306 - DNA, 315 bp, Homo sapiens
aatacatcatgcacctgcctgcttggctgactaggtttcttgtcttccctgtctgcctggtaaggctggactctctgcataactcccccccaactttcccaggtgaaattagctgctccctcctcaaagtgccattgtcctatttaacttacatggccacctttcctggtaatcatgagatctgcaatggcagggtctacgccctgttcatcggctaagccagcaggggcctgggaaaggcggactgtctgaggggcaaggacaggatgaccattttagactatgcctgccatttataagactttggacatacct

SEQ ID NO: 386307 - DNA, 144 bp, Homo sapiens
agggggagtctggctatgactttagaatttcctgatcgaaatttctcctctaaagctccccaccctacttgggatctgaggttatcatcccctcccagtcccaagaacccttcttcccttgttggcagaaatctccaggaagca

SEQ ID NO: 386308 - DNA, 452 bp, Homo sapiens
tcattctgttcaatttaatgaaggcctatgatgtgtcaggcactgtcctatactctgaggacacaggagtggccaagagacaaaattgcatcccctcatggaacttgtattccagtgaacagtaagaagaatggttttgctttcctgctccttgctctaagacgggtatgagatagttttggtcaatgagttgtgagcattgtgagcctctggctgaagcttttcatttttttttttttattttttttttttatttttttgctggtacaaggccagtgctctcctttcctgccttaatcatggaaccacatacagagagagcagccatgaaatcaaagcagtccagaacactgagccactgcatggagggcggctattcccaagagtctccagacctatagtgaactttgtgagaacaagaaataaacatttgttctgttaaatcactgaga

SEQ ID NO: 386309 - DNA, 369 bp, Homo sapiens
tcattctgttcaatttaatgaaggcctatgatgtgtcaggcactgtcctatactctgaggacacaggagtggccaagagacaaaattgcatcccctcatggaacttgtattccagtgaacagtaagaagaatggttttgctttcctgctccttgctctaagacgggtatgagatagttttggtcaatgagttgtgagcattgtgagcctctggctgaagcttttcatttttttttttttattatactttaagttttagggtacatgtgcatgatgggcaggtttgttacatatgtatacatgtgccatgttggtgtgctgcacccagtaactcgtcattttatttttctttttgcttagacttaatttc

SEQ ID NO: 386310 - DNA, 532 bp, Homo sapiens
taaaaacaatggaaaaattgaaccatacaaacatactttaaatatgtgctgtcagaagtagctactaaaggattaattccaccaaagtgagggaaggtttgaaaagaaaaacattgtatacccatattcaaagcagcattattcacgatagccaagacaacacacaccaacacatgaatgaagaaaatgtggtatatatcgacaacggaatatcattcagccttaagaaggaaacctggtcacaggctgcaacagggataaacctgaaggacactgctaagtaaaataagccaatcacaaagaaaacccaatactgcacatttccatttatatgaggtgtctaaactgaaagtagactaatggctgctaggggctcggtgagggggatggatgaatgtttgttcaatgggcatagagtttcagtgttgcaagatgaaaagttctagagatctgttgcacaactatgtatttacagttaatactgtactactgtatactttaaaatagttaagataccaaattttacataatg

SEQ ID NO: 386311 - DNA, 1045 bp, Homo sapiens
tcttagttgccgcaggtgagggtgatacgggtgtttaagtaatggtttctctctccttgtgacactacagttaaagagagaaaacccagaaagtaatagaaaactttttaagggcaattatttgatggagcccattgtaaagaaaggaaatagaaatgatggttgagaagtgaagtttttataagagaggtgggacttctgatgagattaaaagaaactattcagccaagtattaagcctatttgtagaaacccaagaagatagaaatgctgatgatacctccctcagttctctagatgttacagtttataaaatgcttcagatgtttcctcctgaagtcttaatgcatgctgcaggttggtaagatgttactttcctcagcagaagccaaagctttgaatgtcttggtagctaccagggtaatagggccaaacgaggaatggggttccattaggattcaatttcagaacttaaggctattcctcgtccttgtcagtggcataagtgccatcttagtgatgagagagctgttggaggtggcctttagcaggatcttatggcaggttaatgaagtcttgccatttgatcttcagtgtctctgtgaaacagataagtttcaagtttacgtaccaattcagcaaggttaagtgatttgaccaagaacacacagccagttcaccgtagagctgaaactaaaaatttcattttgtggattccaaatcttcctgttctgttgtttaaccattccatagtaggatgagaacacttttgtctagattgattgtagtttgcagaaagatgtggaggagaaaggagtatatactgagtaatatgtatagtatcagatgttttatattctggggtcgttatcttatttaacccttaatataacctgagaggttggtctttgtttcacagatgaactgacagagcactcattaacctggtaactcatttacctggtaacacctcttacaagacacttccataggttaggatttggtgaccagtctaatgaagtagtggagatggggagcagggatgg

SEQ ID NO: 386312 - DNA, 360 bp, Homo sapiens
tcatctttccgtacttagaaatcctctaagtctctcagcaacaactttacacctgatccatgaaaaatataatgttggcttggcgtggtggctcacgcctgtaatcccagcactttgggaggctgaggcaggtggatcacctgaggtcaggagttcaagactagcctgaccaacatggtgaaaccccatctctactaaaactacaaaaaagttagctgagtgtggtggtgggcacctgtagtcccagttacctgggaggctgagataggagaatctcttgaacccgggagtcggaggttgcagtgaaccgagatctcaccactgcactccaacctggcaacagagtgagactccatctca

SEQ ID NO: 386313 - DNA, 373 bp, Homo sapiens
aagcatattttaaacttggttgcttgtctatataaaaatgatgatattccttctcattcacatctgtcagtaaagatcacaaatattccctctgtcctataactttcttctatgaaaataagttctataaaagtcttcattttctatatttgagggaaactaatataattgtggaagttcccttttagaattttttcttacaattaaaaaaatagatgtcaagcaatggtgaatatactgtgtaaaaagcataatgttttaagttatggtattgccataaaggacttataacactaatttgtctgaaatataatcaagggaattagaaagcaatattgtcattttgagatatggagatatttcagaaaattac

SEQ ID NO: 386314 - DNA, 371 bp, Homo sapiens
tagatacggggtttcaccatgttggccaggctggtcgtgaactcctgacctcagctgatccacctgcctccgcctcccaaagtactgggattacaggtgtgtgccaccgtgcccagcctcaagccaacctttcgccttagcgtcttgactttctgggaccacaggcatgcgctaccacgcttaatttttttattttttattatagagacgcggttttgccatgttgcctaagctggtctcgaactcctgagctcaagtgatccgcctgcttaggcctccaaaaatgctgggattacaggtatgagccaccatgcccagcctagaaataatatttaaagagataatggcttgaaatttcagattcgaaaaaa

SEQ ID NO: 386315 - DNA, 573 bp, Homo sapiens
tgagactactcaggagtcctgtattgccagcgactgacagactgctagagctgcaaattccctcggccccgaagaaggggctagatttcttttgataccttggtctaaatagaggaggggaggctagctgaagcgatttttttacagaagcagaataggcaaaaagttaaaagataaatggttacagaaacagttacaggaaaataaacagttccaggtacaggggcttaaattatcacaaagtgataaacgcaggggctttgggtaccatcaaccgagcgcgttcccaggagctgctggtacagcttgctccagtttcttatcagtattttatcagtaagcgcattcctggatgtgcttggagtcagcttgccccagttatgtccttaagggacggggacaaggggctgcaagcgaagaaaccaaaatggtgtctgtccggccctctcagctaagagagagtcagtcaggttaaaacaaagtagggtatcacaccgagaggcgcaggttgcggagagccaagatcgcaccattgcactccagtctgggagacaagagcgaaactcggtctca

SEQ ID NO: 386316 - DNA, 457 bp, Homo sapiens
aggggtttaacttttacattattattgaaaagaggaggggaaaggtctataaagctctgatctctctagaagtccacatacatggaaagtaaatagttaatttctagtgtagaaaaataacaccgtggtgccagtaggtgtgtccttgtgtttataaatatacatagtggatgttttagaccatttaatgagacctattatatattgaatacctgctgtatgccaggaactgtgcctgatgctttgtataatttctattatatcagcccagaaatagtgattttatgatctgtctaccggggaatgaactaacgttcatagaagtatagtaattgttcgaggtcttgcagttttaagtagtaaagttgccattggatcacaaaagctgtattcttccccctacacctatggtttccaaatgtgagcatcagaattaatttgggagatgtttttaaat

SEQ ID NO: 386317 - DNA, 212 bp, Homo sapiens
ctctgtggctagaacactccaaggccctttggtacccatcaaagtgggccccttgccaggtggcttttcagttacagagtccaatggaccattttttagaaccatgcacctccccgcaaagggtggggtagggtgggaaaaaggagcaggtctggaggtttgtggaacccagttcctacagaatttgtaaaacctaaataaatcatggccat

SEQ ID NO: 386318 - DNA, 387 bp, Homo sapiens
agtcatgtaatgttgttggcctctgctttgcaacctgaaaatggggacagtagtgaccttacagagttggtataaggatgaaataaattacaggaggaaatgaaggatcagggacacaattatgtgcccaacagcaccacgccattagggtaagttgccttctcctaaacccggcatacaatctgaccctgagcaaggaagaatctgactgcttttatctcctcgaaccttcctaaagccaactcttagggggaatgcacatcaagcttcttatctcctcgaaacttcctaaagccaactcttagggggactgcacatcaagccttcctgatctgacacctggaatccctttagtctgactcaaatgtatggctgcaatgtcaaaca

SEQ ID NO: 386319 - DNA, 811 bp, Homo sapiens
tgaactttcaattccatctcctcaattagagagacctccataccatccagctcccagctctggctgtgctcagtgaagtagcccactattactattactgttgcaaatagtgagagatacaggcgcatgccactatgcccagctaatttttagtagagatggggtttcaccatgttggccatgctggtctgaaactcctgacctcaggtgatctgcctgcctcggcctcccaaagtgctgggattacaggtgtgagccaccccacccagccaattttattgaatttttaatagaaatgattatatcatctgaaatactgatcattttgctatttcccttcctgctcttacctcttgcatgtacctcctctcttggcatagagctggaagcctcctattgtatgccaaatgttgggggaattggcagcaggacatatggcagggaggacaaaggtaagtggcctcaaggacaatggaggtaacattgtcatgttccctatcttaaagaaatgcatcggctgggcgcagtgactcctgcctgtaattccagcactttgggaggctgaggcaggaggactgcttgagtccgggagcttgagaccagcctgaacaacatagcaaaaccctgtctctaaaaaatttaaaaattagcaggacatggtggtacatgctgtggtcccagctactcaggaggctgaggcaggaggaccactcaagcccagaaggttgaggctgcagtgaatcatgatcacacaactgcactccagcctgggtgacaaactgagaccctataaaagaaagagaaagagaag

SEQ ID NO: 386320 - DNA, 293 bp, Homo sapiens
caaagatgacattataactgatcccccagaaatacaaaagatcctaagagactattatgaacacctctacatacacagactagaaaatctgaaggaaatgcataaattcctggaaacacacaatctcctaaaactgaatcaggaagaaattgaaacactgaacagaccaatatcgagttctgaaattgaatcagtaatttaaaaacctacaaaccaaaaaatatcccagaccgggtggattcataggtgaattctaccagacatacaaacaagagctggtaccaattctgctg

SEQ ID NO: 386321 - DNA, 524 bp, Homo sapiens
tgaccttctcttatcttcctttcacttgcccaaggcaggactctaatctaattgtaagtctaaagacttttattccagagagttcctgccccatactctggaggaaggaatgctgtacagagaggccaagaaaaatctgaactgaagggtgttggttgatttagatcataccctttttgtccagtcacatttctacatggttgtcaatcttgcctacactatgaagtcttcataaaaggcccaagaggactgggtctccagagagcttctggatagctgagcatgtggaggtttagggagagtggtgtgcccagggagggcatggaagcaccacgccccttcccccatatctcaccttacacatctcttcatctgtgtgctttgtaatgtcctttacaataaaccgttaaacgttaagtaggtgtttccttgagttctgtgagccactccagcaaattaattgaaaccgtgggatcccaacttgaaaccagtctatcagaagttctggaggtccagacctgtga

SEQ ID NO: 386322 - DNA, 352 bp, Homo sapiens
tcaatctataaatccaatataatatctatcaaatttccaatttcattcttcacggatattaaaaaaatcttaaaatccatgtgaaactacaaaacaccccaaatagccaaataaatcttaatcaaaaagagcaatgctagaggatttacactatctaatttcaaaatatattacaaagctatcctaactaaaacagcatggtattggcataaaaacaggcatgtagaccagtggaacaaaaatagggggcccaggcataaatccacatatttacatgcaacttatttttgacaaagttgcaaacattcaatggggaaaagacagtattttcaacaaatggtgctgggaaaag

SEQ ID NO: 386323 - DNA, 470 bp, Homo sapiens
gtgtctttaaacaaaactaacaacgggaaagacgatgacaaggaaatcacagtcatccactcagtggagctcatacatcttttgtgccttgaaaaaggtttgtcaaattcaggaccataatttaggaacgaaatgatcatcatacccttggtctcaggaagtttgtatagggccctgcactaccttcatgaagaaattcttctttcctttggggccaataccactcagaaacaaatagctatgaactggctttttaaaaacctccagacaccagcctggccaacgtaatgaaactccgtctctactaaaaataaaaaaaattagcgggcgtggtggcaggcgcctgtaatcccacctacttgggagactgaagcaggagaatcacttgaacccgggaggcggaggttgcagtgagccgagatcgcgccactgcactccagcccaggcgacagtgcaagactccgttgtca

SEQ ID NO: 386324 - DNA, 650 bp, Homo sapiens
caggtgatccacccacctctgcctcccaaagtgctgggattacaggcatgagccaccgcgcctggccagaagaaatctttatcttggtgtgcagtgtctggtgagggacaaatgtcatctctcttggatctgaatctggaaggatcaaggcactgaagggatttttttgtttcagacagtatccctctgtcgccaggctggagtgcagtggcgcaatctcagctcacggcaacctctgcctcccgggctcaagggatcctcctgcctcagcctctcgagtagctgggactacaggcacgcgtcaccaggcccagctaatttttgtatttttagtagagacagggttttaccacggtggccaggatggtctcaatctcttgacatcatgatccacctgccttggcctcccaaagggctgggattacaggcgtgagccaccacgcccggcctcactgaagggatttttttaatgtcacgtggctctcacaggtgcggtgtgtttgggtgcaagtgaagattacgactgatgcttaaaaacaaatgtaaaattccaggtggtgttgctatggggagcagctttaggacaatctgagtggtttcagttgcaagagtgtgcgtgtacgtgcaagtgctacagtcaagattcaact

SEQ ID NO: 386325 - DNA, 243 bp, Homo sapiens
tagccaggcctggtgacacatgcctgtagtcccacctactcgggagactgaggtgggaggactacttgattttttgagctcaggaagtcgaggctacagtgaaccatgattgcaccactgtacttcagcctgggcaacagagagaaagaccttgtttaaaaaaaagaaaagaatcaatttatttgatatatgagttatttaagtactcaaaaaattttgttaaatcacacaatgtagagctta

SEQ ID NO: 386326 - DNA, 457 bp, Homo sapiens
aactgtacatgtatatagaaagtgtatgtgtagagtgacaacattgagagtgctacagcctgaggcagcagaagagcagctttcctttatgtctcaggatgtatcatttctgtgtttctcagaaagcggaacctcattacattcttatctctttcataaattgcctatcagcttccagacttacaagaccagaaatttataactaagacagaggggttaagacaggcagagaggagagggcacgtgcatgtccccagaggccccaggtttagagatagacagacaactagctgactggccattttcaggcatttgcaatcaagctgttaaagacttttaaagagatgagagtaatcgactgtgttcattttgggaggagcctggacccaggaaggcaatcatgggactgctcaggcatacagtagtagtggcagccataatttgatcagaagctact

SEQ ID NO: 386327 - DNA, 1337 bp, Homo sapiens
gcttcctacttctgaagttctgaaatgaaccaggtgtataagaatgaacattcaacgaaacatgcatcctttttaaaatttagctttctagtacagaccatgcatttttcctctttgaactctttcatggatgccaagcagtgcctcactggaagtccttatcatcgtgcgtaaacatccagggctgtcactgttggcgatacagctcatgtgagagctgtggcagagcttcagacggaataattatgaacagcattgtaggaggtagttactatgggaaaatataataatggaggtcaaataaaggagacacaagctttcatcagttgggcgtcttcattttcttttggcgaagagaagctcagttctctttgtaaattaaaagctttttttctttccttccctttccctttccccttcctcctttccccttttcctcttcccccttccccctctcctcccctcttttcaaataaggacatattctcaccatcttgctcatgctgctttcaatctcctggcatcaagcagtcctcccaccttggcctcccgaagttctggtacaagtgggagccaccatgcctgggcagaccctcagttctaaaaccgtcttggcttgtttaccatcagcccttcaccgtttcagaaagatgctgttcggagaactgtaagggaattttccaattagttctgtttttctttctttttttcattagccctctcagctgacatgtgagttacataaactttttaattgagattcatgtgttcaaaatcatgttttaattttgtttttggttttgtggtagcttgatatgatgtggtactacctcttgtgaagtttaaagtttgtatttatgaaagggcatgggacgtgaaaaaattctgttttttatcttgagccgcagcttagcttgggatattaggattagcagtcactggagtggaacgtttccagtggcttccgtaaagtaccctggattcctcttccctggattactagagagcggcttccgagcatagccgctgcgaactgtaaaagcttgtggtcagtgaactcagttaagaaagtgctggcgatggtgaaagtcaagcccctttagatggtggttctttcgtggaccgggtgccttctctttgtgagcagattacccagtttggcgtcaaggggctgttaggcattccttcttccaggaaaacatttcctgaggctgtaggactcaactatgagaggcagttgtgaaggaggaaaaataatgtaagaattaactgaggtaatataaggcgtttgtgaatagaaacaagtggagaagcagttgtagagagataatttgtaa

SEQ ID NO: 386328 - DNA, 198 bp, Homo sapiens
ctgccttccttcttgtcataatcgttctgcttgaaatggacgttgtgaaaagcctaatttcagcttagaaaaatgtcctcttctaccgcccttcccattcaatggattaaggataaaagcagacaaacagattgaacatagaaactctgaaattatttacaatttcagaatcggtaatcaaagcaagagctccacagt

SEQ ID NO: 386329 - DNA, 319 bp, Homo sapiens
gggagctctggagtcagactgcccaaatttgaatcctgccccagccctttactaggtatgtgaccttgagcaaactgcttcatcatctataagataaaatcttacagggttgttgtggaaataaaataagataatgcatataagcactgagatcctaataaaagttaactgtcatggttatcatttccttggctgtcttccacttcagatggttccagaccttgatccacctgttaaaaggcaacattggcacaggactcctgggactccctctggcggtgaaaaatgcaggcatcgtggtaagggtctgcatcagtgg

SEQ ID NO: 386330 - DNA, 422 bp, Homo sapiens
caaggctaggagtttgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcacttccaggttctttcattgagtgccccttgaggaggctggaggagaggccaatgacatttgcacttgagactccagagtctagatttataaccactatgttacggctgccagagtggctgcaaggacacttctttcattcattcatttacaatacatgtagcatctgctgtgtgccagatgccattctaggttctagggaaacaaggcagagcccctgttttc

SEQ ID NO: 386331 - DNA, 320 bp, Homo sapiens
aatcgatggtctggaggttggcaggccagttcttcctcatgaggtcatctagggcctgaggctctttcatctggtggcttgtggatcttctgaggttgttcctcatctgcatagtggcagatggcctaccacaccacgtctgcatttaagccattaggaaagaggggatgagagggaagggcacatttctttccagttgagggcatgacccaaaaattgcacacatcacttttgctcccaaaagttgcagggttgcacggacatctaactgcaagtgagtctaagaaacgtcgtctgtaagtgccagtatgtctattctt

SEQ ID NO: 386332 - DNA, 638 bp, Homo sapiens
atagaatcgagccggtaccaattcggccgggacaatgaatatgttcattatgttgattgtggtgatgttttcttgattgtgtacatatgtcaaaatttatcaaattgtacatattaaatatgtgcagtttttgaaatgtcaattacacctcaaactgttaaaaaatgtaggcacacaaaataataatacacacatgcaaggaacacacaaacaaaaacacacataccacacagaatgactggaggaaaagagaatcacagaacagcaggggaaagggagtacataaataaatacatttgagaatcataagagagggactctatgtggtagagagaaaagtgaggggggaaaaatgaaatttactctgttagaatggtgccccttttaaagacagtaaattctctaagattaaaacaattgaatctcaacagtagaagtttcagaccactaatcatatgaatgaggaaatatttagaagttcagagtttttcctggtatccctgaaataactcaaactcaatgtattcattcatttaacaaatatttactgagtgcctaccatgtgccagcttctgttcttagggccagtacttttctttttattttttaaattttgttttagagataggattatggtc

SEQ ID NO: 386333 - DNA, 720 bp, Homo sapiens
ccggtacatcacgtttacatgcatgcggaaaatgggcttggagattcttgattcaaatccgaggtatcacacatcggcccccaaaggtcaaacattaagaaggaagcttactgccctgtcccagacttttctaggtgacttcttcctccggactctgcagcagtcttactagttctgaaagcacaagcggaccgcacgtctcaacgcgggaaaacagttccatctgcagggatggaggaccgggctagacaagctggagttggctctgcgccgcaggggtgtgcaagcccaagactggggagcccgaggtcaccccggccgccctggcatcggggctgaggtgcaggctcctggaggagcggtgcgcaggcccaggggtagccgaggacacaagccaaggcacgagcggacaaccttacggggacgagtactaccgcccggacgcgacttcgcgagaggccaggcggaacccactggaagcgtgagctagcggggaccacccccgggcgaaaccaaaggagaaagaggggaacccaggggtcccggggcgcttaggcccgcgcggacggggaggccagagttgccccgaagctatctccttacctcaccggcccccacgggctccgcgctcagctacagcccggcgggagcaatgcggcagccacaacagttgccggcggtcgccgcgggccggaaagcggggttcggggatgggaaggg

SEQ ID NO: 386334 - DNA, 346 bp, Homo sapiens
cctcctcggttcaagcgattctcctgtctcagtctcccgagtagctgggattacaggcgcatgccactacacccgtctaattttgtatttttagtagagatgggatttcaccatgttggccaggctggtctcaaactcctgacctcagatgatctgcccgcctcagcctcccaaactcaactaaagaacatataattttaagcatatatgatacagctatattaaaaaaaaaaaaaaaaactaggccgggggtggtggctcacactggtaagcccagcactttgagaggctgagggggagggatcgtttgagcccaggagtttgagaccagtctgggcaatatagt

SEQ ID NO: 386335 - DNA, 418 bp, Homo sapiens
aaggatgctccctcttgaggccaacctggaatcctcctgcattgaattgacaattttgaatctgctactatatcctgttggatgtcaacagctaaggaaaggtatggaccatcatatacagggtcttactctattgaactgaacttctgtaagcactcagaatgaatctatatggtagctttctactaccctaaaagtaaggtcaggagttaggaatgaactctaaacagttttaaacttgaagtttatatttaggcacagtttcttctaatagagtaagatattagaaattatgaaaacttggccgggcacggtggctcatgcctgtaatcccagcacttttggaggccgaggtgggcggatcacgaggtcaagagattgagaccatcctggccaacatggtgaaactccgtctcta

SEQ ID NO: 386336 - DNA, 476 bp, Homo sapiens
acagaatagagaacctctaaataaagacagacacttaaaactaactgatcttcgacaaagaatacaaaaacataaattgggaaatagacaccctatttgataaatggcgctgggaaaattggatagccacatgtagaagaatgaaactggatccctttctctcactatattacaaaagttaactcaaaatggattaaagatttaaatccaagacctgaaactataaaaattctagaagaaaacctaagaaaaactcttctggacattgatctaggtaaagaatttatgataaagactccaaaaacaaatgcaacaaaaccaaaaataaataaatgggaccaaattaaattaaaaagcttctacacagcaaaataaataatcatcagaatagacaacctgtagaatgggagaaaatatttgcaaattatgaacccaacaaaggactgatatgcggaatatacaaataaatcagcaag

SEQ ID NO: 386337 - DNA, 307 bp, Homo sapiens
agtaccataaatatgttttttttctttccaagagtgagccagccaaactaataacgcttagctaagaaacatcctaaggctagctcagagattattttggatactattgaaatttgggcattaaagttataactgtgggtctccaaagtatattaatgaagaagactcaaaaccattctcttaaagtgagccagttattgtcagccttttgcttttggttgcagttcttataacttagagttacactttttttttgttagaagatacttttccttcagaaaaatagaataataatgttttataatta

SEQ ID NO: 386338 - DNA, 192 bp, Homo sapiens
tacaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagc

SEQ ID NO: 386339 - DNA, 336 bp, Homo sapiens
aatttgatcatattgtgccttggtgtagtttacttcatgtttcttgacttgaaacttgttgaaatttttgaaactttagatttatcattttctgcaaatttgaacaactttttggccatttttcctttaaatattttttctagatacctctacctcccatgtgtctgattgtatacacatgtggccacatatgtcccacagctcactgatgttcaattcatgttttctagtctttttttcctcccatttaattttagagtttctattcttgtttaaaattcagaaatttcactgtcttatctgccattaatcctatccagtgcttttttcacttga

SEQ ID NO: 386340 - DNA, 579 bp, Homo sapiens
agttttattgcctaggatgcttaacctgaatccaaccaagtctgtggactaaactcccagctcgatgggattgcccaggggtggaggtaaaggaacaagctaaatgcccccaggaggaagcaatcagataaatccagaatgtggttctgacagtcttggcattccccaagacaagtggcctgagttcttcaagatttcaacatcacgaaataaaatgggaggggaaaacgtcttgtgaatatcacttattactcaagtgtcagaacatcttccatcctggaaagttctaaaacagacctgtgaattgaataaggagatgaacttcaggtctcaatgacagaaaaaaaaaaaaaacaacccagatcaacccgtcttacacaaaatcaggaaggcagtggctcatataactgtaattgaacctgagaggctttaagttggagctacttgctgcaaaaggagacaaaatcttgagtatggagacaacagaggaggattgagtgacattggcaaaagcaccgaggctttgtaacgttgtttgggcccctctggacattgctctccagggcaatttgagttggg

SEQ ID NO: 386341 - DNA, 131 bp, Homo sapiens
tctccctacatcataccttgtgagctccacaaaagcagaggctttgtcaggcttgctcacagctatatagctggttcctacaatcaggaacacatcaagcattcaataaacatttagtgaacaaatgaaca

SEQ ID NO: 386342 - DNA, 792 bp, Homo sapiens
tgtagtatttggaatttggtgatgccatttgctcgagtaaggcagagctggaataaagaaagagcgtggaaaggacgagcaggaaagggtagcgatagaagggtgctaacgaaggaaaaaaagaaaaaaatgttgatggtgagggtggagaggaggggcctggtagaccctggccactgggtaaggccctggcctggctgttttggacaaatgatggatcttaatttaaagacctccagggaggcagatacgcaagcacctgggtctgaacctcccaagcagtcacgggtctgtcagatggctcgaaatcctcaccggtgcagatgacagcgagacagggcagctcattgcccctgcagtcccccgctccccactcctcatggctggatctctgaccctccctcctctgctccacgagaaagaatctccacctcttgggcaacagtctcttggtatcacagtgctgtggcgggcatgggactcaagggcgttggactgaggcaggctttcaaggcaagggttaggcagtctctgactccctgcagataaatgcaaaatgctgaatttgtgcctttccttggattcctgaaaagagaggccataccttaaattctcaaagcgctccctgctccgcaaaatatcaggaaccactgttctaagggggaggaaagatgagcctgtgattgccaatgggtaaccatgaggcctgaaaatgtttcccgtcaaataatttcagcccatcctgattcctggggttcatgaggccacagcagttcaactcagttaagtgca

SEQ ID NO: 386343 - DNA, 617 bp, Homo sapiens
ggcacgaggctcagtggtgaaggctgtgcggacactgggggcccgccaggggtttggccccttactcaacccaaccacggtcctctccggcgcaggccgatttgaggacctagactccttgatgctgacggcctgagggggctcccgggtgccggatatctgacacaggccagggaggctcccctgggagacctggcaggcctggaggtgtgagtcggctctgagcagctgctctgggagagccagtccacggagccaaagctggagggcagctgccggccacaagttggggaggaggagagacgcaaggccgtcagatgcttgtcctggaaaccaaccatgagctgtgatgaaatccaggcaactgagttgtgtttcagcccaaagcagcaaatggaatccagcttcaggaccatcatctgacataggggaagaagacttacatagaaggcctaaccagcacccaagatcatggctggtgtcagagaaggctgaattgggtaccaagacattccttctctccaggtggtaacaaggaccctcacatggtattaatgaagaccaaatgtttgaatttctgcttgacttcttcaattgtgaaatctggatctatgcag

SEQ ID NO: 386344 - DNA, 1120 bp, Homo sapiens
ggcacgaggctcagtggtgaaggctgtgcggacactgggggcccgccaggggtttggccccttactcaacccaaccacggtcctctccggcgcaggccgatttgaggacctagactccttgatgctgacggcctgagggggctcccgggtgccggatatctgacacaggccagggaggctcccctgggagacctggcaggcctggaggtgtgagtcggctctgagcagctgctctgggagagccagtccacggagccaaagctggagggcagctgccggccacaagttggggaggaggagagacgcaaggccgtcagatgcttgtcctggaaaccaaccatgagctgtgatgaaatccaggcaactgagttgtgtttcagcccaaagcagcaaatggaatccaggtgactgacatcattatctatcagacatgtgagagaactccttagaatgatgttactcattatctgcaaccacatgagaaacccggagcaagaaccacccagccaaggccaatctctagaactttgaaagataatcataaataaagcttcaggaccatcatctgacataggggaagaagacttacatagaaggcctaaccagcacccaagatcatgctcataggtggaggagacttgctttgtctcagatgagactttggactgtggacttttgagttaatgctgaaatgagttgagactttggggaactgttgggaaggcatgattggttttaaatatgaatatatgagatttgggagggggtcaggggtggaatgatatggtttggctctgtgtccccacccaaatctcatcttgtagctcccataatcctcccatgttgtgggagggacccagtgggagatgattgaatcatgagggcgggtctttctcatgctgttcatgatcccattcatgtgagaaagacccatgtgatcatgaatgggtctcacaagatctgatggtgttaaaaatgggagtttctctgcacaagctctctgcctgctgccattcacaaaggatgtgacttgcttctccttgccttctgctatgattgtgaggcctccctagccatgtggaactgtgagtccaattaaacctctttcttttgtaaattg

SEQ ID NO: 386345 - DNA, 781 bp, Homo sapiens
cactcggcagagaccccagaaggagccgggggcagcatcagagcctggggcctgggcaggggtgcccgagagcacagcagctgcaggccattgggaaggccagaagacagggaatggaaagccagggacgcatggagtgactcagagaagggactattcagctgggagtcctgcatttgccctttgtgtttcatccggggattttgaaaccaggtttttatctggacctcccagagctgcatctccctggccagcctcttccgctcttgagagcccaagtactggtggtaccggaagacggtctccaaggcgcggcacgaggctcagtggtgaaggctgtgcggacactgggggcccgccaggggtttggccccttactcaacccaaccacggtcctctccggcgcaggccgatttgaggacctagactccttgatgctgacggcctgagggggctcccgggtgccggatatctgacacaggccagggaggctcccctgggagacctggcaggcctggaggtgtgagtcggctctgagcagctgctctgggagagccagtccacggagccaaagctggagggcagctgccggccacaagttggggaggaggagagacgcaaggccgtcaggtgggccggagggaaggctgggcggggctggccaggcgcaggatctacctgggtgatttttttaatctataaaataatatttgcttttaatttttaatgttactatgttgtcaatatattgtaaagcttaaactctttttccttaagacca

SEQ ID NO: 386346 - DNA, 974 bp, Homo sapiens
ggcacgaggctcagtggtgaaggctgtgcggacactgggggcccgccaggggtttggccccttactcaacccaaccacggtcctctccggcgcaggccgatttgaggacctagactccttgatgctgacggcctgagggggctcccgggtgccggatatctgacacaggccagggaggctcccctgggagacctggcaggcctggaggtgtgagtcggctctgagcagctgctctgggagagccagtccacggagccaaagctggagggcagctgccggccacaagttggggaggaggagagacgcaaggccgtcagatgcttgtcctggaaaccaaccatgagctgtgatgaaatccaggcaactgagttgtgtttcagcccaaagcagcaaatggaatccagcttcaggaccatcatctgacataggggaagaagacttacatagaaggcctaaccagcacccaagatcatgctcataggtggaggagacttgctttgtctcagatgagactttggactgtggacttttgagttaatgctgaaatgagttgagactttggggaactgttgggaaggcatgattggttttaaatatgaatatatgagatttgggagggggtcaggggtggaatgatatggtttggctctgtgtccccacccaaatctcatcttgtagctcccataatcctcccatgttgtgggagggacccagtgggagatgattgaatcatgagggcgggtctttctcatgctgttcatgatcccattcatgtgagaaagacccatgtgatcatgaatgggtctcacaagatctgatggtgttaaaaatgggagtttctctgcacaagctctctgcctgctgccattcacaaaggatgtgacttgcttctccttgccttctgctatgattgtgaggcctccctagccatgtggaactgtgagtccaattaaacctctttcttttgtaaattg

SEQ ID NO: 386347 - DNA, 365 bp, Homo sapiens
tgagacctcctacatgccaggcaccagggaagtgtcgtaaattcagcagtgaagaggcaaggtccttgccttcatggtgcttattgtctggtgcaggagacagatcataaacaaataggtatattgacaagacctttccagattataatcatagctatgaaagaagtaagatgatggtgagatagagaataagggcatgccatctgaaatagggtggtgacagcaggcttctctgtggaggtaacatttgtccttaagcctgaaggatgagcaacaaccagccctggaaagcaccaatgaggagtactgcaggcagaggaaagagcgcttgcaaaggccctggggttggaaagagctcaccatat

SEQ ID NO: 386348 - DNA, 792 bp, Homo sapiens
ggtcagttttcatttgttgtttttataaatagaatcttgctaaatttttatgtgatcttctaattatttcattagcaaaaaatccctggattaacggatggacatggcatggcacggtggctcacgcctgtaatcccagtactttgagaggctgaggcaggcggattacttgaggccaggagtttgagaccagcttgggcaatattgtggaaccttgtttccacaaaaaataaaaaaaattagccaggtgtggtggtgtgcatctgtaatcccagctactctgcaggctgagaacccaggactgcactccaacctggatgacagagcgagactgtcttaaaacaaaacaaaacaagataaaaacagtagatatatttataaggcccatttgaggtgtaagtgacttaacatccctggcacttgaacactaatgaatattatgactgccactttaaaggaggcagaagaagtttaaaaagtaaaacaaaaagtttgtttcagaaaacaagcattttacctctgtttcaaatagtctaatttttttagtgatgaaaacttctgagaccagtagatgtttgtaaataaaaaacatttatggcagtctttgtaactgtaatgaaactggtagagagtaataatagcctgttttttgtttgtttgtttgctttgggggatatttgcaatacagtttattgatatgtcacatacatgtaaagtttataattcaccccagaatttatattactaagtttgtgctagtattaaagagcttttcaaattcagtgcctgttt

SEQ ID NO: 386349 - DNA, 298 bp, Homo sapiens
actgtattcataacttttactctttagatcataagcttaagtgaaagttatgtgttcaagtcacttatgaagatagacttcaagccttaaatttttaggtaatttgaccatgatattcttcagtatgggaaagttaatgtttatattgtttcatccagtacctaatatagggtctttcacaggcaaattttcagtaaatgactaaatttttctgtctttatttttcaagagatggggtcttgctctgttgctcaggctggaatgcaatggcacaatcatagctaactgcagtttcgaa

SEQ ID NO: 386350 - DNA, 387 bp, Homo sapiens
tgagtaactaaacccctctgagccccaacattcccacctctaacagcaagatgctggtgggatccccatctcatgggattgttggaggagcagaaaatgacatggaaggagctttggggtcactgtcagctcctcaccacaaagtgaggagatcccgccactaccaccaccaccaaggtgggaagaaacacatccaaatcagaccttcccaggaatcacaggatttcagagcccaaagtgcctccctgtttgtcttagagattaaggaagagtcccctgtcacaggatcccatgaaccagtgagacaggctccctctctcctgagagagctgggattgacagctgacacttggggaaaggaggccaggggtccaagagcaacacagg

SEQ ID NO: 386351 - DNA, 593 bp, Homo sapiens
  misc_feature (20)..(20): n is a, c, g, or t
caagtgcctagtcttctganaaatcatggaattctgtgaattattacctaaatctgcacatgagcaaacagcctgggcgacagagtgagactcctgtctcaaaaaaaagtactgctttgggcagtaaactacgtggtcgctcttgacctacgggataaccagttttccatgctcatgccccccagctagcccgcgctttcactaaagtttaaaaaccatgtagtgattattacccttttttttttttgagctccgtctcaagaaaaaaaaaaaaaaaaagaatagcacacatggaaaagtgcacaaaacataaatgtaaaacctaatgatttatcaaaaagtgagcctgggttagcatcacccatgccatggtactgaacagtcaagcagaagacctctgcagggtaattggtgttccaactacttttgtgataatcgcttccttgcttttggagttgtaccacctgagaatgtgtccctaaacactatagtttcgttttgtctgttccttgaactttatgtaaattgaattatacagtattattttgtgtctgccttcttttgcacaagaatacacttgcaaaactccttta

SEQ ID NO: 386352 - DNA, 456 bp, Homo sapiens
ctttaagcagttctcctttccatgtggtaccttaacctaaatctaaccaaccaacctcacttagaacttcagaactactctcttccagataaaagtatctccttgggataactatctcactagaaactttcacctgagttgcagagtatgaccacgagagcacttaaaggagactgatcaaagtcagaaaacagatgttaagaacgtgaacctcaaattcatttattcattcgatgcaatagctgcatttctaaaaatcttcatataatcgaaattcagtaggaattttttcaatgaggaggaagacagtcttagacgttcaaaaacaaaagcatttttcctgtattgaatttcaataataatagtgttttgtgtggttataagtgcagtactataaaacttaaatatgattgagcgaattcagcactctattacgtacagctttctttccagaaa

SEQ ID NO: 386353 - DNA, 412 bp, Homo sapiens
catttggggtttgaggttctgcgtttggcattggtttgctgtttcacttgggcaaatctcttggcctctctgggctgcgtttctgtagggaatcagtaataaggcaacctgtctggctctaaggctcagaggcacggggcaggctttgaatttccagcaagcaggagaaagagcctttgatttgaagcagagatttcctcttgaacattaatattctgggcttttccaggctggagctttagaaccgctgttactaaactaagtgacatgagtagccccccgttgcttacagaatttcttggcttggcatttggggttttctcacgttgattctaccctgcctgtatggcttaacccccaactacacccctacactgtaattaggaagagcctcagacttccccacacaccc

SEQ ID NO: 386354 - DNA, 188 bp, Homo sapiens
ggaggttgccatgagccaagattgcgccagtgcactccagtctgagtgacagggtgagactctgtctccaaagaaaccgtaatcacctggtctctagtctttggctttgacgctgaactgtctgagctgaccctggtagaaggcaccagaacaggcccactggaggtccggggcacttgctttaagaa

SEQ ID NO: 386355 - DNA, 376 bp, Homo sapiens
ttacttcggtgtatggtggtacttccggtgtcatagaccttgcacaacaaccctatgggtagccactattacaaatcccattatggagaggaggaagctgggaacgagactgtacacagtgagtaagaggctgaacccaggctggtctgccaccagagcctgagggctgcagcgcctgcctgccatccagcctgcatcctcctgcagaggccacgggcagctgccccgtcctctttgatactaggagtagagaacggacttcctacctttatttgaaaatgagactctctttccttttcaccattgtcatctcccagcctactgtgcaacagacccaagtaaagtgtatttctccagctgggtctctacctcacac

SEQ ID NO: 386356 - DNA, 1154 bp, Homo sapiens
aacaaggcactgacaaaattatattcacaaacagtttagataatcatctatcatagattataaaatgactatgtttaataaaattttaaaaataaaagagggagagaatgggctcaaaaaaagaaataaaaggctgggcatggtggctcgcacctgtaatcccagcactttggaaggccgagacgggcggatcatgaggtcaagagatcaagaccatcctggccaaaatggtgaaaccccgtctctgctaaaaatacaaaaattagttgggtgtggtggcatgcacctgtaatccaagctactcggcctccccaagtgctgggatcaaaggtgtgagccactgtgcccagcccctacataaatttcaaacaccacattccctgaatacaacacaaaaaagttagaaatcaaataatgaaaatataactagcaaaattctgtatgtttgaaaattttaaatattttcccagaaactataaaactacatgttaatgtggataaatctcaaacaatcttaactgaaataattaaatcacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcacttcttgagctggggctagagatctgggtaatcatttcatttttattttttaaactacatataagctttgtacacttttggatattagaacttcaatacacaattataaaaaagagaaacagggaaaaaagtataattgtcaagatggagctaaaaaaataacatgggtgaacaaggtgccacccacatgcaagcttccttcccatgtcaggtaatgcctctcctcatctgctccatcaatcaataaaggcataatcactcctgtgatacctttaagaaaagaacacactctctcaaagctgggtgcagtggtgcacgcctgtaatcccagcctcctttgggaggccgaggcgggcagatcacctgaggtcaggagttggagaccagcgaaacccatctctactaaaaatacaaaaattagctgggcgtggt

SEQ ID NO: 386357 - DNA, 970 bp, Homo sapiens
caacctctgcctcccggattcaagcaattctcacgcctcagcctcccaagtggctgggattacagacaaacgccaccacatgcagctaatttttttatttttagtagagacagggtttcaccatgttggccaggctggtctcaaactcctggcctcaagtgatctgcctgcctcagcctccccaagtgctgggatcaaaggtgtgagccactgtgcccagcccctacataaatttcaaacaccacattccctgaatacaacacaaaaaagttagaaatcaaataatgaaaatataactagcaaaattctgtatgtttgaaaattttaaatattttcccagaaactatatcacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcacttcttgagctggggctagagatctgggtaatcatttcatttttattttttaaactacatataagctttgtacacttttggatattagaacttcaatacacaattataaaaaagagaaacagggaaaaaagtataattgtcaagatggagctaaaaaaataacatgggtgaacaaggtgccacccacatgcaagcttccttcccatgtcaggtaatgcctctcctcatctgctccatcaatcaataaaggcataatcactcctgtgatacctttaagaaaagaacacactctctcaaagctgggtgcagtggtgcacgcctgtaatcccagcctcctttgggaggccgaggcgggcagatcacctgaggtcaggagttggagaccagcgaaacccatctctactaaaaatacaaaaattagctgggcgtggt

SEQ ID NO: 386358 - DNA, 421 bp, Homo sapiens
aacaaggcactgacaaaattatattcacaaacagtttagataatcatctatcatagattataaaatgactatgtttaataaaattttaaaaataaaagagggagagaatgggctcaaaaaaagaaataaaaggctgggcatggtggctcgcacctgtaatcccagcactttggaaggccgagacgggcggatcatgaggtcaagagatcaagaccatcctggccaaaatggtgaaaccccgtctctgctaaaaatacaaaaattagttgggtgtggtggcatgcacctgtaatccaagctactcgggaggctgaggcaggagaatcgcatgaacccgggaggcagaggttgcagtgagccaagatcgcgtcactgcactccagcctggatgacagagcaagactccatctcaaaaaaaaaa

SEQ ID NO: 386359 - DNA, 1024 bp, Homo sapiens
caacctctgcctcccggattcaagcaattctcacgcctcagcctcccaagtggctgggattacagacaaacgccaccacatgcagctaatttttttatttttagtagagacagggtttcaccatgttggccaggctggtctcaaactcctggcctcaagtgatctgcctgcctcagcctccccaagtgctgggatcaaaggtgtgagccactgtgcccagcccctacataaatttcaaacaccacattccctgaatacaacacaaaaaagttagaaatcaaataatgaaaatataactagcaaaattctgtatgtttgaaaattttaaatattttcccagaaactataaaactacatgttaatgtggataaatctcaaacaatcttaactgaaataattaaatcacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcacttcttgagctggggctagagatctgggtaatcatttcatttttattttttaaactacatataagctttgtacacttttggatattagaacttcaatacacaattataaaaaagagaaacagggaaaaaagtataattgtcaagatggagctaaaaaaataacatgggtgaacaaggtgccacccacatgcaagcttccttcccatgtcaggtaatgcctctcctcatctgctccatcaatcaataaaggcataatcactcctgtgatacctttaagaaaagaacacactctctcaaagctgggtgcagtggtgcacgcctgtaatcccagcctcctttgggaggccgaggcgggcagatcacctgaggtcaggagttggagaccagcgaaacccatctctactaaaaatacaaaaattagctgggcgtggt

SEQ ID NO: 386360 - DNA, 3987 bp, Homo sapiens
gagagagagagagagagagagagagagagagagagagaggcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaacta

SEQ ID NO: 386361 - DNA, 3802 bp, Homo sapiens
ctaaaaaatatgttctctacaacaccaaggctcattaaaatattttaaatattaatatacatttcttctgtcagaaatacataaaactttattatatcagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaacta

SEQ ID NO: 386362 - DNA, 4200 bp, Homo sapiens
gagagagagagagagagagagagagagagagagagagaggcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaactaaaacacagaaggaatacgaaaaaagaaatagtccagaaaagaaggaaaacaaaaaaaatacgggggggcgccccggccccccaaaaaatgataacaaccttgggggcgccgccccaggtaaaagagcaggcgtccaaaaacagccgaaaggggggggtcccacaaaaacgcgggcggggaaacaaggtgtgggggggtcacaagaaaaccggg

SEQ ID NO: 386363 - DNA, 1786 bp, Homo sapiens
gagagagagagagagagagagagagagagagagagagaggcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtatgtcattcttagatttcttgttgcaatgcttaatctataggattcaggaagacagggccattgcatacagttgttcaggttgttcactgcacaagggcacccagccagggtttgattaggagcagaaattctacccacactaggtttgccaagccaagtgtcctgatgacaggttaatcctatcctgacgaaggcactgttttttctaatttgaacaatacaccatgtggatcaacatcaacattgttagaatatataatcaaatatgtgatatagtaatttcagagcttgacctacttgcagaaagacagaaaaaaagagaaatatgatgttattcatttacaggatatgacggcacaatctcataagcaaaaccttaattcaattatatcatttaataaatttggcacaataaagatagcaaaatata

SEQ ID NO: 386364 - DNA, 4058 bp, Homo sapiens
agtggcagagcaggtttaggcccggcctgggaaactggggagctgaggtgctcgcgccgccgctctgagcccgagtgcgcgcctctcaggggccgcggccggggctggagaacgctgctgctccgctcgcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaacta

SEQ ID NO: 386365 - DNA, 1142 bp, Homo sapiens
catcatattatactcaagcatttacacagtctcacttctaggaactactagtacctatctgactcacacggtcagatcctccctactatgcctagaaatgattgatactatcgttgttcattatagctatctctcactaatccacttcaagcagcccactccctacttacacacacatgaattggtgcctattgccatactaaatcttctgaccggctctgtcataaagctagacgcgttaagagtcctactctcctaatctacttctctaattgcgtcgcatcctaccagtatccgaccttatcactcatcagttacctataagctaaagaccctatctccaccaaatataattatagaaatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaacta

SEQ ID NO: 386366 - DNA, 1515 bp, Homo sapiens
  misc_feature (14)..(14): n is a, c, g, or t
tttgtctcttcctnagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttccgccaagttgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcatgaggaagtctccagaaatgccagtaatcctggaagtgtccctggaaggatcccatgacacagccaattgtgaggcatgcactttgggcatatgtggacagggcttaaaaagctacatgacaaagccgtccaaatccctactcccccacctaaagactgggaattcctcacctggaattggtgctgtgtacctcgcaaaccaagccaagaaccagtcagatgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagctatcctctgaaaacagtatgaaacatgaccaagtacataatggatttagtaataaatattgtcgaattgctaaaaagtcttcaatcattcattcactaagtcactcagtgatatcaatatacttagctcagaaagtgtgggaggctgaataatggtgtctcccaacatatgcatgacttaatccccagaacctgtaaacatgttactttacatggtagaatggactttgcggatgtaattaaggaccttgaaatggttagattatttcatattgtccgggtggataagaaccaggattttgtaacagggaggcaacaagctcaaaatcagaaaaaagagatttgtcaatggaacaagaggttgaagtgctttgaagttggaggaagaggtcacaggcaaaaaagtacaggcagcctttagaaacccaaaaggacaaaggaacagattctcccctggagtctgcagaaggaaccagccctgcctgcacatggctttagcccagtgacactgattttggacatctgaccttcagaactgcttgctcataaacttgtcttgttttaatgcaaaaaaattg

SEQ ID NO: 386367 - DNA, 1009 bp, Homo sapiens
  misc_feature (14)..(14): n is a, c, g, or t
tttgtctcttcctnagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttccgccaagttgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcatgaggaagtctccagaaatgccagtaatcctggaagtgtccctggaaggatcccatgacacagccaattgtgaggcatgcactttgggcatatgtggacagggcttaaaaagctacatgacaaagccgtccaaatccctactcccccacctaaagactgggaattcctcacctggaattggtgctgtgtacctcgcaaaccaagccaagaaccagtcagatgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagctatcctctgaaaacagtatgaaacatgaccaagtacataatggatttagtaataaatattgtcgaattgct

SEQ ID NO: 386368 - DNA, 449 bp, Homo sapiens
attgttaaatttctgttgttttaagccacccattgtgtagtactctgttatagtagcccaagaaaaccaatacactgtataatggaacattatttagccataaaaaatgaattaagggctgatacatgctacaatgcagacagactttaagaaaacataatgttaagtacaagaaaccagacacacaagactatttattatgtggttccacttatatgagacgtctaaaacagaaaaatctatagagataagcaaattagcacatgtcaagggctggggtgaaatgtagagtgactactaatgagtacacaattttttttgagatgatgaaaatgttctaaaattgtcgtgatagttgcataactctgtcattataccaaaaaaatcattgaattgtataatttaaaaagtatgtgaattatatctcaataaaatattttaaaaacaga

SEQ ID NO: 386369 - DNA, 733 bp, Homo sapiens
cgtccggtgaacgcagagggctgtgaggaggaagagggaataagtagacggcgagtagaaaggagagtacagtgatgaataggacgagtacgtggtaagactacagaaaaagtgagcccggaacaatgaatggacttgagcgagaaagagaactagggcgaacaagaaacaaggataagattccgagcaggtgatgaactagcgcgcggtggcagaaataagagaaatcgccgttatgggcagctcccttggcgaggtataagagtgttgtgaagagagggaataggtgaaggaaggataggatacagaacaccatcggagggacgcgaagataagagagggcggggacctggaacgcttgtataatggaacattatttagccataaaaaatgaattaagggctgatacatgctacaatgcagacagactttaagaaaacataatgttaagtacaagaaaccagacacacaagactatttattatgtggttccacttatatgagacgtctaaaacagaaaaatctatagagataagcaaattagcacatgtcaagggctggggtgaaatgtagagtgactactaatgagtacacaattttttttgagatgatgaaaatgttctaaaattgtcgtgatagttgcataactctgtcattataccaaaaaaatcattgaattgtataatttaaaaagtatgtgaattatatctcaataaaatattttaaaaacaga

SEQ ID NO: 386370 - DNA, 268 bp, Homo sapiens
ttcaaatgcaagctatcagttttctccaaaaggtctggacttaggcagtttgctgcttttacattctcacttctgttagattttctcaagagatcctcaatctagcatgaagcgaagaggaagatttgaatctcacctcttccacttaacagctgtgacactgggcaagttatttcaggtctttgaaagtcagtttccacatttgttaaatgagattaagaatccttacctcataaccactttagaaatccttttggcagtatctact

SEQ ID NO: 386371 - DNA, 607 bp, Homo sapiens
atgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggag

SEQ ID NO: 386372 - DNA, 155 bp, Homo sapiens
atgcaggagccagcttcagcagaactcctggctagcagctctgcctggcagtacagaaactgtctcaaaatgtgaaacagatgagccttttaaagaaagttatttatattgtggaatctttcagagcaagcagaaacttgaagagccttatcacc

SEQ ID NO: 386373 - DNA, 223 bp, Homo sapiens
gtgcaagtcctcactccctttctcccatgatgacacatttctcctccgtggctgccttttagcttttgttgtttcaaagctggcttctgtctgagctctgattgttgtagagaaagatgctgtcattcattaggaagtgatagctgaatgctacaatggatgcttccagactttatctctctgtgtgtgtgtgtgtgtgtgtgtgtgtgtgtgtgtgtgtgtt

SEQ ID NO: 386374 - DNA, 517 bp, Homo sapiens
ttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttg

SEQ ID NO: 386375 - DNA, 454 bp, Homo sapiens
atcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatg

SEQ ID NO: 386376 - DNA, 3150 bp, Homo sapiens
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgctgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgcccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtaaggagttca

SEQ ID NO: 386377 - DNA, 1218 bp, Homo sapiens
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgctgactctaagagttccaacagcaatgttatccaggtggaccagtctgggctctttctgccctctcgggattactacttaaacagaactgccaatgagaaagtaaggaacatcttccgaacccccatccctacccctggctgagctgggctgatccctgttgacttttccctttgccaagggtcagagcagggaaggtgagcctatcctgtcacctagtgaacaaactgcccctcctttctttcttcttttcttcctccctccctccctttcttccccttttccttccttccttcctcttattcttctagtaggtttcatagacacctactgtgtgccaggtccagtgggggaattctgagatataagtttccgagccattgccacaggaagcgttcagtgtcgatgggttcatggacctagatagctgagaacaaagctcacaagagggtc

SEQ ID NO: 386378 - DNA, 102 bp, Homo sapiens
cgtcgcgctgcaggagctgggagctggcagcaacgtgagtgggggccccgggctccacgggaggggactgggtggagggggacgaggcagaggggtcggccg

SEQ ID NO: 386379 - DNA, 3237 bp, Homo sapiens
gcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacatggtggagtacaaacgggccacgcttcgggatgaagacgcacccgagacccccgtagagggcggggcctccccggacgccatggaggtgggattccagaaggggacaagacagctgttaggctcacgcacgcagctggagctggtcttagcaggtgcctctctactgctggctgcactgcttctgggctgccttgtggccctaggggtccagtaccacagagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttgaaaacaccaccttcaactccagcagtgaagctgagcagaagacacagcgcttctacctatcttgcctacaggtggagcgcattgaggagctgggagcccagccactgagagacctcattgagaagattggtggttggaacattacggggccctgggaccaggacaactttatggaggtgttgaaggcagtagcagggacctacagggccaccccattcttcaccgtctacatcagtgctgactctaagagttccaacagcaatgttatccaggtggaccagtctgggctctttctgccctctcgggattactacttaaacagaactgccaatgagaaagtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgcccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtaaggagttca

SEQ ID NO: 386380 - DNA, 2553 bp, Homo sapiens
ggtggtccccccctccccccctggcacccacagatgtgagacgccctctccccaaaaaaaaaaaaaaaaaaaaaaaagaagaagaagaagtaagtaaacaatacttagccaatggaggtaagcagtgtgtcaaaaatgaaacaggtcatccagaaaggcttccagaaggatcaagcagaagagatattgggcagaggtggtggtaagaacagatctcagccttgggcaggacttgttgctgggctctgaggatcacccgggccttgacaggtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaagcatcctgaacaattacctgatctggaacctggtgcaaaagacaacctcaagcctggaccgacgctttgagtctgcacaagagaagctgctggagaccctctatggcactaagaagtcctgtgtgccgaggtggcagacctgcatctccaacacggatgacgcccttggctttgctttggggtccctcttcgtgaaggccacgtttgaccggcaaagcaaagaaattgcagaggggatgatcagcgaaatccggaccgcatttgaggaggccctgggacagctggtttggatggatgagaagacccgccaggcagccaaggagaaagcagatgccatctatgatatgattggtttcccagactttatcctggagcccaaagagctggatgatgtttatgacgggtacgaaatttctgaagattctttcttccaaaacatgttgaatttgtacaacttctctgccaaggttatggctgaccagctccgcaagcctcccagccgagaccagtggagcatgaccccccagacagtgaatgcctactaccttccaactaagaatgagatcgtcttccccgctggcatcctgcaggcccccttctatgcccgcaaccaccccaaggccctgaacttcggtggcatcggtgtggtcatgggccatgagttgacgcatgcctttgatgaccaagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgcttacaaagcatggctgagaaagcatggggaggagcagcaactgccagccgtggggctcaccaaccaccagctcttcttcgtgggatttgcccaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgcccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcccccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtaaggagttca

SEQ ID NO: 386381 - DNA, 850 bp, Homo sapiens
tacacagaccccaagtgtctttttctctttctacatttgttagaaaggtaacctgacctttgcttttggtctttcctcccccattctgctaccttcctctcttcttttcttcttactagtttcaaataatgggttggaatcaattcaatgctgctccatccgtcagaggcacttcccaaaatacaagtgtgactcatagtcctcataacccccctttgctttttgtttgactttcaatctcttctatcctctgggcctatttcccaggaaaattgaccaaacataagctactggcagctgtctctctcctccaggatttatagtgtgagataaggagcatggctgacccactcccttgccttccagctctcttcccttcccagaggaatgcatagccaggtgtgaatgcccatttcatggattattcttagttctagaccacctgacttattacctagcatacccattacaacatcagctctatcgctggtgtattagcccacagtttcattttattattagcctaaacaaaagattattaggaaagtaaatctgtcagacgtgtatataaacatatatggaatgccaaatataaaggatttttatattgtccatgattttttaaaatctataattgtcttcctatgtaagcatgaataattaagagctcaatgtttttgctgttgtaagtattgggatgtatgctttctgcagaacctattttgaactgtgtgccatgctttaagaccagtgtttgtcccatatacagtatgaattcacttagtaaccaatatttattgattgctttctctgtggtaggcacttcgttaagtgatcaaaatacaaaaaa

SEQ ID NO: 386382 - DNA, 876 bp, Homo sapiens
cgtaagttttcttttgaaagttgtatcattttaggtcctacattttggtcttttatcccattttgagcctaatttgtgtacatgttacaagcttttactatattttatgagctgttttcttagtggctgccctgggattacaatgaacatcttaattcataacagtcttgtttggattaatacgaacttcatttcagtaatatgtaaagactttctttctatatagctctgttccttcccgaacattgtgttattgtcatctaaattacatctttatgcattatatgtctaccaatgtagatttataattatttcttcttgtagttgtcttttaaattaaaaagaaaaagaattacaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaatttttggcccccttcccccaaactttttttatttttcaaattttttttttgggggcccaaatttgggctttttgtgaaaaacccccttttggggggggttttaaaaaaaaaggggcggggttttaaaaaagggggctgggaaaaaactcgtgggtcccccaaaaaaattgcctttgaaaaaaaccccttttttcgcgggggggcaataatccggagggcccccccccaacgcctttctcaaaaattggcgcccccccggtgggtattaaaaattcggggcgattatttttaaaaaccgcggcaaattttttttaacaccccttttttttaccaaaaggcgcccaatgcggaaaccccttttatat

SEQ ID NO: 386383 - DNA, 2131 bp, Homo sapiens
  misc_feature (27)..(27): n is a, c, g, or t
aaggctagtagggccgggggaatcggncgaggggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattggtagcttgctctaaacttacaaatgttttagagaattctttggcatgatctgactttccaactaaaatgtgagcaacttg

SEQ ID NO: 386384 - DNA, 2329 bp, Homo sapiens
  misc_feature (27)..(27): n is a, c, g, or t
aaggctagtagggccgggggaatcggncgaggggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagacggagtttcactgtgtcacccaggctggagtgcagtggtgtgagctcggctcactgcaacctctgcctcccgggttcaagcagttctcccatctcagcctcctgagtagcttggattacagtctttggtagatgagtggctggatagctacaagcaagaccaggatgcaggatttctggagcttgttaactttttcatctgatcttgtggatgtaaaggcactgtgagccctgagatgttcaagaagatgtccaactcagagatcatccagcacctaacagagcgtttaatgaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattggtagcttgctctaaacttacaaatgttttagagaattctttggcatgatctgactttccaactaaaatgtgagcaacttg

SEQ ID NO: 386385 - DNA, 2011 bp, Homo sapiens
  misc_feature (27)..(27): n is a, c, g, or t
aaggctagtagggccgggggaatcggncgaggggagatgtccgcccccagtcgtagcctcggacggtttctgagcgttggtgtttggcacgcgccaccctctcttgctttggttccgccatgccgatgtaccagtctttggtagatgagtggctggatagctacaagcaagaccaggatgcaggatttctggagcttgttaactttttcatctgatcttgtggatgtaaaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattggtagcttgctctaaacttacaaatgttttagagaattctttggcatgatctgactttccaactaaaatgtgagcaacttg

SEQ ID NO: 386386 - DNA, 2020 bp, Homo sapiens
tccgaacgaccgcagcagggtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaagtcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattggtagcttgctctaaacttacaaatgttttagagaattctttggcatgatctgactttccaactaaaatgtgagcaacttg

SEQ ID NO: 386387 - DNA, 1627 bp, Homo sapiens
gcctcccaaagtgctgggattacaggtgtgagccatggcgcccagcccagatgccacaatttaaaagggttactttcctgggtcaagctgccttttttgggggtcattagggaaggaatggatgtgtgctctacgggttcttagaatagcaatgaaccttcataatcagactcattccttaattttgcttactttttcatgcagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattggtagcttgctctaaacttacaaatgttttagagaattctttggcatgatctgactttccaactaaaatgtgagcaacttg

SEQ ID NO: 386388 - DNA, 757 bp, Homo sapiens
tccgaacgaccgcagcagggtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaagagagattgccttatagcagatacacagttggatgttggcagaccgttgaccagggggtcttttgattccccacctaagctctttgcacagtgtttccttgctcatattcaggtatatctgtaaatgatcacagcatcctgttattttcctcgtaagcacctcatatccttcattctttaggcactgtgagccctgagatgttcaagaagatgtccaactcagagatcatccagcacctaacagagcgtttaatgaggtggaagaagatgaccaggatcctcttacccctcttatttcaaaacacaatgcctattatccccttctttttgattctgtgaaatagggtagcttttagaaggtggagttcagtctcttgggggtaaaagagatctgaatatgcctctcaaactg

SEQ ID NO: 386389 - DNA, 2126 bp, Homo sapiens
tccgaacgaccgcagcagggtcacaagggagatgtccgcccccagtcgtagcctcggacggtttctgagcgttggtgtttggcacgcgccaccctctcttgctttggttccgccatgccgatgtaccaggtaaaaccttatcacgggcgcggcgcgcctctccgtgtggagcttcccacctgcatgtaccggctctctaacgtgcaaggcaggagcggcggcccagcgcccggcgttggccacctacagtctttggtagatgagtggctggatagctacaagcaagaccaggatgcaggatttctggagcttgttaactttttcatctgatcttgtggatgtaaaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctgctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagagctgcattaatactacattgtcaaagacaaagacgaacatgagacatgcgatatgagttttaaaaggagagaagagcaaaaaaacaatacagctatccaaggagcaagtgctgagcttgtgaaaaaacagcttctattttattaaataatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctggtgagtgctctaagttttcattttactcatgtcatcctcaatgcatcataaatgccatagacaccattactatcacgtaggctcatagcagctgatgtgctgtatatgcttgagagggtggtatcaattaactatattatctataaagccatacttgcaattactaccacttcacaatttatcattaacgcatttggcagatttttttttctccaaagtaacatttatttaaaggtttatcaaaattcttagaacagcatttattataatgtgatttttgataattgactaaatcagtggctcttaaaaacaccctcatctcagtcccgctcagtatacaccacagtgccatttggggaaaagaaatacatattagaaatgttcatttcagacctcgtcatggaagatcatatattaatgtaatcaggtggtacgtttacatgctcattagtaatccatcattagtccaaatgctcactattaggaataaatgtacaacgagttattcagaatacccagaaagagtatttcttatttaaacattcaggacaagctgactgaaataagtgcacaccttgaatttgaactttcaaggcacatcactaaagtcaatcagttatgtcaggacactcttctataataatctcaattataaaattcctgcctctccctaacacaggagttggagggagttccaatatctgaatctttctaattcactgtaactgcaaaaaaatcttgatgaagtgtgtatttaaatttcatgccttaatacatagcatgccactaaaaccacattagttatgctttatgctgcttaatcatacgtcaaaatctgtaaaatctgctcttgcatgctaaggtaatttaactgcaattaatcaattaagaaaaataaaatgtaataaatgccaaataatgtaacttcttttaaacagaccactatctacacatttattccccaaatacttattagctgacaccatataaggaaaacataataaaaagtagacttcactgagcctttctcccattggtagcttgctctaaacttacaaatgttttagagaattctttggcatgatctgactttccaactaaaatgtgagcaacttg

SEQ ID NO: 386390 - DNA, 937 bp, Homo sapiens
aaggagtgaggagactggtttctgactcgcttcttgcaggtgtttcaagctggtagggaggggagataggctcctccctttatttcttctgctgcatgacagtttctcagctttaattattagaacacattgctaaaggaaatggatgacagattttttttaatggagagagaatgagcgccataggagaaactttccaaaattagatgaaaaacaggacttctggtctttgagagaacttttgatttaaaggaagagagtgaatccctgtgtcctgggggccatcttccttgtttttgtggatgcaccggagcagttgtgtgtcccctgtgttacataaggtgtgctgtgtttattttttaatttttaaaatattttaaaaatttttgtaaggatgaagtctctctatgttgcccacgctggtcttgaactcctggcctcaagcgatcctcctgccttagcctcccaaagtgttgggactatgggcatgagccactgcactgggccgccatgctgtatttaggattaggcatccagagttctcagcataagagactagcaggtgaatagctaacgtttacttggtgcctgctatgtgcaagcaagtctctgtgcctctttggaccaaaagtacgctggtatttgggatagcacaggagtggggaagttgggggccaggtctagctgcaatagggtccatgtggcaggagctgcttggagggtgatgacttgagttggtgccagatggggcagggtcacccgtgcacccgtggtagcacttcctggatgatataggagaggcacacaactcgctgcccgcatccttaggctgcccaccctgcttccttgagaactaccacaggcacacaccagggagccaacatttaaaaatgtttaaaaggtagagatttcttaccaaactcataccaaaaaaaga

SEQ ID NO: 386391 - DNA, 288 bp, Homo sapiens
aatggtgaaatagaagtccaattacctggggaaacttcatcttaaccctctggaattttcagtctaacctaaatattgatactacacctgcagcagcatttagtttagcatgtagtgaaaaagtaagtctaaaaaatattttcataatctttggttcctaaaattgttttaaaagagatgcagtgacatatgtctggagtttgcttatggccaataggttaatgcttctagcttctatgcttattgcaaattttaattatgtgaatatgcaattttcacttatatttg

SEQ ID NO: 386392 - DNA, 5504 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386393 - DNA, 5400 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatctttta

SEQ ID NO: 386394 - DNA, 3289 bp, Homo sapiens
cgtccggacagcttgatctagatgagcagagctgctgagtagtagatttctagtttctaaacaacaataagtctgcccgcagatagcctcttagcagagccaaaagccagcagagagaagactcagcattgcttggagtaagttgcgtgcgatgggcgcgcctcgatctaataacagctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386395 - DNA, 2744 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386396 - DNA, 1523 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386397 - DNA, 3569 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagtttatgctgtaatagtttatgctgtaatagtttatg

SEQ ID NO: 386398 - DNA, 250 bp, Homo sapiens
agtagaagctgctgatgcaatgggcttttgccagggccaggcgaagggctggggacagggagaacaggagttgcccagtctcctgtgaccgtgaccttacaggtggagaaacgagggaaagctcgctacacccgagacttccccctaaaatggctccaggtgctgagcccccaccgattctttttcggaacaaaacgcccttttcacggaggggctcctgcatggctttcttgccttcctctcccaacag

SEQ ID NO: 386399 - DNA, 316 bp, Homo sapiens
cggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgt

SEQ ID NO: 386400 - DNA, 5450 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386401 - DNA, 5450 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggtagaaaggccagagtgggtttgtggagtcgccactgcgggaccagcacgaaagctgcttgtctgctttggcggagctgagctgtgtatgggatccaggaggctggggtgatttattttatgggattcctggagcgcagggctggtgaatccatgacaaggtccgggagcagcagaccaaaaccacagcagcctcctattaagtgtaacaaatagttaagcaaactcgggctacaaacaaagactttgctacctccctcctccacaacccccaagtaattagccttctggagctggctcttagctgaggctcctgctacctcctgctccacccgccccttcctaggttacaagtaaatcattgtcaagggccagccaggggaaggtttcaattaaggttctgttctgctgcctttgtttctcccctgctgttgtaggcacttacagctgcgttgttatgaaaggagggaatagccctttgtgtctttgatctaattaaacctgcttggctgtgtttatccgcagggcaggtcacagatagggttggctgtgccactccataaagtatctattgtggaagcagccaaaaagggctgctgtggcaggaattggttaatttctccttccacttcccttcctgaatagtgaagggagcccttttaaaacaaggctttggtggtaatcctgtgatttttttttctcccccatcccctcactggcccatccctctcaccctcacttttgttctgctggtgggtaaaatcttaggctgaacacatatttcaatggtaagatacttattttgctatccacacttgatgcaattgaattcaaggtgcaaagtcttgtactgaagcagtctccttgttgcttggagaacacctccttcagagccctttgttaaataagaggggcgacgttgatcatagatgccacctggttagcaccgaatctgactttggtgacagtcctaaagcacagttggtgattgtgagatctgttagcggcaggctgagcagatactacttggttttgcttggtatgagatactactgtttgcttagtatgagattttttccagcctgtctcttaaactcctgtgacatcttcaatgatatgtgccctcagttgcagcatagcttctctgctgcctattgccattgctgtctcaaaagttgagtgaattttgaggcgtcttttttttttttcctctcttgggagtcgttgtaaactactgtgtacaagtcattttgtgatatgattctgaacagttggaatagaatcatagttaagtggtacagccatggctatcgtcaggcctgttgcctggagatctctaagttaaggcaacaagacttaaagaattttctaatacacttgtttcacacatggacgttgaggccatagtctttaaaagcttggacctttgtagcacctcaacatgaaagggcattagctatgtttcctgtttttacagtgatcaccaaacagatcttgccactttgattgttaaaaatgaaccacattctagccctggtctgggactttggagggagatgaatttcttgttggaaatgtaaatctagtgtccatatttaatactctcacagctttgtgtttattctctttgctcatggaatagcagaacaagataaacatgggttaagacatttaggagaacctgctgtatctaacccagttggattttctttcatgcttaacacagtagtgaaaatagaaggtaggccgggcacagtggctcatgcctgtaatcccagcactttgggaggctgaggcaggtagatcacctgaagttaggagttcgagaccagcctggccaacatggcgaaaccctgtctctaccacaaatacagaaaattagctgggcgtggtggcaggcgcctgtaatgcctgctacttgggagcctgaggcagaagaattgcttgaagctgggaagcagaggttgcagtgagccgagatcgcaccactgcactccagcctgggcagcagagcaagtagtaataaccaccgtgtagacaagtgggagggaagaatagaatggcactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386402 - DNA, 1836 bp, Homo sapiens
tacaacatcctgtcgtctaccagaaatcacggtaagttaagtgaggcatgtgcagacagtgtgtctctgtaaagagacttgctgactctgtgaactactgcgtgtggaatacatctcgcattaaaagacatgcgggcaccgcgagaggatcgcgagtcgatgcctgagaatcaatcccaaatggacgttccatggacgtgtcgactatgacatgagactcatgatacgatacaatagacgctaccgtgtagactcgatgagtcagggtaagaactacgagatcggtgactgtccagctctgggctagccagatcaactcccccacccgtcttcttcctctgtcccagaatggaaaatgatgtatggtcagtcacgctgaagtatagcagcgactgtgttaagagagagcagtgactctctcttctagagaagaggttttcaataacagggcttggaaatgaactagaataggaaatagatcttttcagatgctgctttcccatgtaatacaagcgtttctacagggtaccagaggtgtgaaatatgtgacacttaagaacagtgatttttattgggaattttcttagggttattacacttaaagcaacaaccaactagtaacagctccaggaaaggggaatgaatcaactcttggttctttcctgaagacggcagtgttgtggataagtgagtttttaatgccctggcagtggctacatttgacactttagaaaaaataaacatatttaataatttttgtttctccttaggaataagactgtagaactgttttgtactgtgaattacggatgctctttgaaggaaagaaatatcgattctaatgttcttcagaagttctggcagggataagcaggacatcgactggaacgtatgctaaatgaaagcagacaaatttctattttcttacctgagcaaatattttattgaaactgcttatgtatgtcaaaggagcccacaacttcagctacacaactttttgtattgaaagaactcatactttttgtagcttttatttcacatttaatttaaagtgacttttagcactaaaatgcctagaagattttactccagacctataaggaaatgtttagtttttatgaaaaatgacaagtcgatggttaaacttctcatgtctttggtgctttggccctaatagcactggacaacaccacgaccacatggaaacatatttttggaagcaaaactttaattttatataacgtatgctatggagagctaagacaatttaaggactacttgttttctattttttttcttaataaaatggaatccactgtgttgaagactcttgatatcatgtgcttgtctaaccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataatacttgtgactcatgaagaattatgttgacaaacaggataaattccacatgcattttatttcccagtgagttgtataaactttatttttgttgaaggttgtatgttaaatcaatgttacattcttatatcacttcttgagaaggaagttccgatttgaaattgtatcatttccttcaaaatgaagggcagtgcttagttaaataaaagattgatgatatcttttaagccatttcctcttcactatgtcttattaaaataaaacctgtcaagttcttttcaaaagatgctatgagcgtttccaataaaccatctattagagttcactgga

SEQ ID NO: 386403 - DNA, 1969 bp, Homo sapiens
cggggagtgagcgcctgtctctttaaatgccacgggctgcgctcccgcccgggagcccggagccggatctacaatcccgtccctccagctccggtgcttgttgctcgcccggcccaagcgggagctgttgccgccaggctgcgaggctgccgtcctctcctcctcgcgccccacctcccccgagagctggctgaggaggggcagcagccccagctggcgggaggaagcgcggtgtgaacagggattgccccccgccttcaagtatcggggcgctacgcagccgcgggggaaagacatgcccctagtctgcccgctgcgctgccctctgcccagcctcgctgccgcccgcgccgggagaggagggactgccgagcctacaccttcaaactcgccctagaagtctcggggcgcggcagggagcccttccccaggccccacggccttcacctctccgcgggtagcctcagcccctgtccggggacctgtgcaaatgaccctggagttggtttcgctttctccccttgcggcggtgtgaacgtgtgtccgcagcgtgatgggcaaccaggtggagaaattgacccacctaagttacaaggaagttcccacggccgacccgactggcgtggaccgggacgacgggccccgcattggggtctcctacattttctccaatgacgatgaggacgtggagccgcagccgccgcctcaggggccagatggcggcggcttgcccgacggtggggacgggccgccgccgccccagccgcagccctacgatccgcggctgcacgaggtggaatgctccgtgttctaccgggacgaatgcatctaccagaagagcttcgcgccgggctcggcggcgctgagtacctacacgcccgagaacctgctcaacaagtgcaagccgggcgatctggtggagttcgtgtcgcaggctcagtacccgcactgggccgtatatgtgggtaacttccaggtggtgcacctgcaccggctggaggtgattaacagcttcctgactgacgccagccagggccgtcgcggccgcgtggtcaacgatctgtaccgctacaagccgctaagctccagcgccgtggtgcgcaacgcgctggcgcacgtgggtgccaaggagcgcgagctgagctggcgcaactcggagagtttcgccgcctggtgccgctacggcaagcgcgagttcaagatcggcggcgagctgcgcatcggcaagcagccctaccggctgcagattcagctgtcggcgcagcgcagccacacgctcgagttccagagtctagaggacctgatcatggagaagcgacgcaacgaccagatcgggcgcgcggccgtgctgcaggagctcgccacgcacctgcacccggcggagccggaggagggcgacagcaacgtggcgcggactacgccgcctcccgggcgcccccctgcgcccagctccgaggaggaggacggagaggcagtggcacactgatgggcgagctgagcgcagagctgcgaaggggaactgtttgcagtagcagccgctgctccctttctccctctcttcctccctcttttgccactgtctgggccccatctgggattcctgggccctttggaaaagagttggtgaaatgcgcagccggctgtggacgggggaggaggaaggggacagagggagcaggtaggaaacactttagttgggggtggggggcgtctccctctggccccctgtctgtcttcctctccgcggtggagcaaactgtggacttgcctggcacttaaaccttggtagatctgggtttataatcggccattcttaagcacgtggggttgggggaaagttcggagtacccattcctgccgttgcttcctatcctgggcttggaagaatcctggaacacctctcccaggcaagacattttcacagcaccattcgcaacggttgggacaaaccccaacttttccttcatca

SEQ ID NO: 386404 - DNA, 358 bp, Homo sapiens
ggagggaaagtataacttttatttacaaataattattgagcatgctagatgctactagaacaaaagttacagtttccactgttaaggagaaacaatggagaaaccagcgtgactccagtgctttcttcgatttggtgcactgaagaatcccattttgggagcagaaaaaccctgtgtgttgtgttagctgttccttatcaccaacgagagtaagtattgttaccctcactacatctatgggtaactgaggcacaaacgttgtgaggcagttaatgttcccagggtcacccatgggccagctgggagggcagcatcgccccgtgaacataccctggggcccacttttatgaatcttaaa

SEQ ID NO: 386405 - DNA, 4407 bp, Homo sapiens
  misc_feature (1945)..(1945): n is a, c, g, or t
  misc_feature (2756)..(2756): n is a, c, g, or t
  misc_feature (3213)..(3213): n is a, c, g, or t
  misc_feature (3221)..(3221): n is a, c, g, or t
  misc_feature (4217)..(4217): n is a, c, g, or t
  misc_feature (4320)..(4320): n is a, c, g, or t
  misc_feature (4328)..(4328): n is a, c, g, or t
agctgccctcttttctactacccaattccagaaaacagcccatccagcccacctcattacatcatcacaaaacatacacaataaaaaatggcaaaccaaagactagtgggaggttcttgttattagaccacccttttaattttccccctgtaggcaatttggaaaattattagagatggaatagatgtgggtttttttttgatagattctttgagattgacaatatgaaagatttagtttagatcacgcaataggatctgtagcctcttggtaattaatgacacggccatccgccctctacttatggtacttccctccagtaataacttctctgctgttattattggaattctgtgtatctgtaggataagtcgaatatatgtttgtcagtgaggctgtttgttattatacgtccccagtgtatggttgcacctataatggtgcagtgtagaacaacaagaagatagaaaactgatagaaaagggggagcattaactctaagaaacacatgagacatttttgctggaagaaatcatctccacactaaagttttccctccctacaattggctttggagagtatgtgcatggtctttgacaaggcaacaaggttccagtcatagatattagccagcccttctcataacattgacacttcatcagaatgtagaagtagaaaaatctgaagaactgtttttgtagctttatttactttcaggtaatccatatcccgtggtcttctgagtaaacctgaaaagatacttgaagtatacgtaaggcaaagggatattatagatataaagccataatataacatacaaattatgttgataaagttagattgataaatgtaactctaacatttgatctttgtggcatttgggtactgtacacttcttggaacaggagtattgtctctcatttagcttttgcatgcccaaccacacctagcaaaaggcctactattgagcagttatgtttagacatgtttctatattaaagatgcctcaggggctaggcaacaaagctgaacactgaccatagttggctatttatttttttgtgaggagattgtaatatttttctgtataactaatttcttaataattataatgattataattataaattctatataaccaatttcttaaaaattttatacttttgggtacaaatgagaactattccaggagagaggtaatttatgtacaactttaatgtaacctaataaaaagggtgacatccatcacctttgctgtattatattatttagatgtcaatcaccacttcaactcaaggggaaggtactaggtaaatgcatggactctagcgcccacctgggagctactggaagcctggggacgctgccccagtgtggtgatgggggatgacctgggactcaactgcttccaccacttcttactcagaagagcaaggaagaggtggtggggagttccaaaacgacatgagtacaaatggcctggagagtaatcaatttaaataaagaggttcagaatcttctaaaggaagcttacaaaagcagtgacttcacagaataaatgatataatcaagagtctgtaaataactaaaaatatgacaataaaggcaataaaggcaaatagcgtaggaaaaactctaggaaggctggtgaagtactatatttttcaggcctacaaagcaaactatgcaagacgatacaaatataaaacaaattttgatgcattttaaaatgcatggtttgtgaaggaaaaaaatctatttgacctcgatgtgagaaacattctctcatgagtgatccaaggttcgtgacattggatttgcaaagaaaaaaatgcatcaacatattacctgacctggcactaacagtatttacaaaacaattataatatgatggccatttattgattttcaacttttagcaatattgtgtaacaaaatgtagaanatattgttatggttgtatgacaaaatataaatatcaacaatcttaaaattatagaagtaaatatttagctgacagaagaggggatgtggaaggaagaatgatgactaatattgacattttacagattgtggagttgaggaagactgtcaaatattgaaataagagagagattttaagaaattagttacagagttaacaggactcaaataatattataaatatcaaacataccaaaaggatatagtaggagagtagtgtgagtaactaaatcttcatttttcatgtatagaaatcaatagatactaaagttgacaaataaaaaattagaggtatactcatataagggtaaagagacaccctaaaaaataaagtaaggacaattcccagaggagtgttaagagttaaaaaaattggctgggctgggagagtctaagcttttctagacagcttgcatggaaatacaaatacatatattcacatgcattactttaaaagtaataaaaatagatgtaaaaaatccctaaattggttaaagaaacgtgctattctgagtccttcgcttattacctcttgtgatttgtctcctccacagttaactccttaggggtacgcattggttacctttgaggtaacttacagaattaaaatgttattcagtagtaacaaataactgtgtcttgattgattgagcttctatagcaatttcccttctaaataggaaacacaaaattatgcgtgcatacaggtctctttattgttcatttaagatttatcgagcaattactatttgcaagtcttaattgtaggctcncattggactcaaggtatatacaatcttttcagtttaataagtaggcaggttaggttgattatttgatcagtatcactcaaatgtctattatgagctaggcactattccaggccctggagatacaatgtttactacaacagggtcctggttctctagaattggaatctactattaataattccccaaaggaggcaccaccttatgcatactatttatttggctgattatgatgtgacagtactctaaatatctgtggaaagaaaaataaccttgtagtatgtttcaattcaaatactatcaaagagatcatgagctctggagaaaactacatttcagaggaagatgaatgagtttaatggaagtatgttacatattagaaatctctaaagcctgaggtcaaagcatgagaacaagttctttaccctgttcatagaactgaaataatattcatttgggnctgtgacntgtagcaatgtatggaaataaagacaagagtatgcctctttgattttttttaaaactctttaaagagattaaaaaaattttactgctttagatgatttagagatctaaatgggagtgttagattcgcgaatttgtaccagtttaagtgtggaagggtaaatgttacagaaatgattggagaagtcagtgatcaggttgagctgtgataattttgaggtcagaggcaaattgggagttatgccaacaaagagtttttctttaaatacacatgattttatatcttgtcatctcctttttcaagagcctccaaatatacatctcagtttctccatccaacccctgcacctggcacatggaaacagatggaagaattcaaaatctcagttaaagttgcctttgaatgtatcatgaactcctgttgtgaagtcttgtgaattagaaacacagtaccaacactctgccaccttgtggcttctggagtcattgcagcacatatagaggaaaatcagcacccagttccagttttactggaacaacatgtcttaggttttttgggcagatactttatttaaaggaatatgtagggttcgtgagaatgcatttcggagttatctttctaatatatatatatttaatatagttatcatgtcattggctataattcattagcctgccacaaaataatgttttccaaattgcagttttaaggatcatgaaatctttgaactaaaagggacctcaaaggttacgcagttcagtatttgaattccttttattatcattctaataggagggactgaagtgtgagcttaaacatctctagggcagcttaattttgcaaagcttactatcccaactatcttcgacaacatttatttgaagatttatacatttaactaatgttgcttggataaagctcaaatttttccatatgaaccatgagaaattatgtaagagtcttttaaagttgcattttccatatttattagttcagcnccaagtatataataggccctcattaaataatagccctgtttggttttcctatatttaaatttttaagatgtaggcttatagattattaacgttgaaatagctntatgttcnatgataaaatgctttcaataaatacacttccagctttccacatttacttttgtctttttaaaaattattttctcattgc

SEQ ID NO: 386406 - DNA, 542 bp, Homo sapiens
agtctcagggtaaataaacgacataaataactacttaaagttggtgtaataacaaatatgtatgaagtgccaagagcacctagatgaaggggtaaacagttctgtttatagaacttacagaaagtggaactgaactggaggatgagctcagaatctccaacctcattccactctactctccttaacttagttctagccatgtagatcatcctctagttcctcaaaactaccaaagttctttcccactttagggtttccatactctacctggacctatctttgtcacacttgtcctctggctatctcctactcattcattagatcagttagtatatcacttcctcagttagcctttctcagactccccagttctcccttatttttctcagagcaaccttaatttctttatatcatttttcacaatatgtaattacataaccacatgtggtggccgggtgcggtggcacacgtctgtaatcccagcactttgggagactgaggcgggcagatcacttgaggtcagaagttcaagaccatcctgg

SEQ ID NO: 386407 - DNA, 370 bp, Homo sapiens
gcagccaagtggtcactacatggcagagagctgtgactgagagacgctgtagaaaaaatgcatgtctgatcctttttatattagtgcttctcctgaggggttaaatgtgcataaaaaagaaaatcagtgctggtgggtttttgttattttccatctagatggaaggttgtcaccagtgtctgcgtttccctgactacacacgggtccctcagggaaaagcaaacccatacatctctgtcctatgattcggtggtaacctttcatttcttcaaaaataacatggtattatggagaggatttgactgctacttcacagtatcttaattttcaaagacgaggaatacttccctcagatgggaggaaaccctaa

SEQ ID NO: 386408 - DNA, 409 bp, Homo sapiens
tgcacattggtaggcgtggtagattagaccattgtttaaaatattctctccctccccatcgcctccatgttggaaagtgcatccccacacccgactttgggcttagccatttaacttgctttggccagtgagatgtcagcagacagaacataatcaaaggtttggaaagtgtttgggctggccttgccctctttatgacactgccataagaagaatgtattcaggctaacttgctggccccaagaggagcgagatacgcatgaagcagaactgctccggccatgccctgttctagttcagctgatccctcatgactgagtgggcccagccaagagcagcagtgcgatcagccaaacgcagccaagatcagccaacacatagacatcagggctgagcaacagctgattaa

SEQ ID NO: 386409 - DNA, 747 bp, Homo sapiens
agcaactttatacatacatacagattccaaatttgcacttaactgctatattatgtatgtacttgttcatgacaccacttggaattcaggtagaggtattttcaatcagctccaacatccctttccttccttggatgtttccaagacaccatcaagccaggcacatttaggcagagaggttgctggggagaatagaacattgccaagctctggcgccaaatactgcactctggcaacgtgtaagtgtaaggcaggcattgtgggtgtgtgacctctgcaatcacacagggcctcatgctcaggagggccctgtgcttgattcaatactctgctggccccatcttgaaattcttaatgatttttgaacaaggggctccacatgtccatttatcagtgagcccctcaaattatatagccagttttgtgtgaggacaaagcaatggacagatactatgaagctcctttctgggtggcattttctctttcttttctccttcctttcagagctaccaagtcaccccacactctagctcaagagctctacctgaccaaaactcaatggcctttcctcaggaaatccagctatgctaatgccaccagaactgagtcagaactcctaactctacaaatatggctcctctgtattgagtgcctgctaggtgccaggcacaacactcaactgggaccaatattatttctgatctgggagatagataggtatgatcagccccatttcacagttgagga

SEQ ID NO: 386410 - DNA, 864 bp, Homo sapiens
gacatctgcccagacctcagtatgaagtaaagttgccttctcattcaaactatagcaacaacagcagcaagaacaaaaactaccaccacaacagattactactagaaaactgctactaaaacaggttttttgcccttattccttttcgaccttccttttctcctgtttatccttcacctcctcctccaccttctttcaaaacctgttattgatgctcatcatcatcatcatcatcatcaagcaaaatgtactagttaagaatacagacttttcgttagacatacattccaggcctagctcttccacttactgcctctgtgaccttgagaaagttattgaactgtctatttaaattattaatttctatatttattcagtggggttaatagtacctaatagcgttgatggaagaaacacatgggatgatgcaaataaaacactaaatttaatgcctggtccataggaacagtgcagcaaatgttatctattaatattactatacttctaatactaataggaaatataacacaggttctcatttgctctgtcattcaacttattacattaatagctaaaatttacggaacacttcaatgtcataagtagtgttctaagccctttatattaattcattcatttattcctcaaagaaattctttgaagtaagtaccattattagtatcctaacccccattttgcagttgaagaagctgaaaggaactgagacaaagaaaggatgaataacttgctgaagatcatacaattagtaagtggtttatacaggatttgtgcctaggtagtcactgtaggaatgctcactgtagtaaatttggaaaatatagctaactattgaaagcaagcaag

SEQ ID NO: 386411 - DNA, 327 bp, Homo sapiens
ataaaaatgacaaattcaaatatatcatcatctcaataaatgcacttgggctaaacactagagggttaaaactcagattgagctttaagaaatccaactaaatactgtttataagaggcagtcttggctgggcgtggtggctaacgcttgtaatcccaggactttaggaggccaaggtgtgtggattgcttgaggccaggagttcatgaccatcctgggcaacacaagaagaccccatctgtattattaaaaataagaagaagaagaaaaaagagacaatcttaaaacataatgacccacctctaaagtagtcagattcaaagaaac

SEQ ID NO: 386412 - DNA, 376 bp, Homo sapiens
caaagcagagactgagaatgctgatgcttattttagtgtgatgcgtaggtgtgttaggtgtagggaggtagggttgggaagtagaaggtcaaggtatgttaatgattctaaactggccagtttttctgtccttaggtataaagttgcgttaaactagactctcttctctggagccccttccttattctgctaagttaatgacagacctggctgtggtaatatcttaatcactataattctttccttctttattacctggcaccaagaagctcatgtcaggcccgataataacctactttgattattttggacctctttcctccccctagttttttcatgactctacgtcttcctctcctcacttttctttctattt

SEQ ID NO: 386413 - DNA, 375 bp, Homo sapiens
ggcatttagttgaactttctgaatggcccttacagcagccagcaaagattgtccagacgtgatctgttgtgatttctttgaagcttatatatagagttgtctagcttcagctttcaggactttgggaaaagggcagttttagtcctccatgatgtcaagccacgagggtaggaaaaaaactagaagtgttagtttgaagagttgtagtcagatcagaggaaatgaaaagaattgagaatttgttaaggactgacaaaacgtacaagacagagcctaccagggtgcactattgttttccattgaaacataaaatttttctctataattactacactccttcattcttgtttacaaaataaatctagtctcattaga

SEQ ID NO: 386414 - DNA, 3612 bp, Homo sapiens
ttttttgagacggagttttcgctgttgttacccagactggaatgcaatggtgcgatctcggctcactgcaacctctgcctcccggattcaggcgattctcctgcctcagcctccgggagtagctggaattacaggcatgcgccaccacacccggctaattttgtatttttagtagagacagggtttctccatgttggtcaggctggtctcaaaactcccgaccccaggtgatctgcctgcctccgcctcccaaagtaatgggattacaggcgtgaccaccgcgcctggcctctccatctcttttaaacttaattttagcaagctttccatgcacccacatgttgttttatgccttacctgtccttttcctttttttcccttaggatactttttcttatttagaaactctcaccatgcttaccgtccttcacatttcctatccccaaagcactttttgaatgttttcttagtttaattttgtacaagggagaattaaggcccacttttggcacattgaacctagttcatgtcctgcatgccctgcagctcccctctgccctccaatccattttctttatactggtggctttcgccttcctgttagtcattgctatttcatcatagcctccttttatccttcctacttcatttcttttcttccctcaagtttacgttgtttgttttttaattattttagaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatataaagatatatagagatgcattcacagggttggctggagaggaagaccattctgtgaccaaaataccttggtcattttttttatattgccttatttccctatggctgagccttgttgtgacacatcaagctt

SEQ ID NO: 386415 - DNA, 2957 bp, Homo sapiens
actgaaatgtgttgtgtctggtatgtatgtactgaggttagtttgattagtcatagtagggtggtgattagtcggatgttgatgagatatttggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatataaagatatatagagatgcattcacagggttggctggagaggaagaccattctgtgaccaaaataccttggtcattttttttatattgccttatttccctatggctgagccttgttgtgacacatcaagctt

SEQ ID NO: 386416 - DNA, 1293 bp, Homo sapiens
tttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaagaattcctctgacatatatttgagaaactgggctactgaaagccctaaccccacttg

SEQ ID NO: 386417 - DNA, 2987 bp, Homo sapiens
tttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatataaagatatatagagatgcattcacagggttggctggagaggaagaccattctgtgaccaaaataccttggtcattttttttatattgccttatttccctatggctgagccttgttgtgacacatcaagctt

SEQ ID NO: 386418 - DNA, 2961 bp, Homo sapiens
agcgaaggccccgcccgggccaaccgcctgcctggtccgccctctgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatataaagatatatagagatgcattcacagggttggctggagaggaagaccattctgtgaccaaaataccttggtcattttttttatattgccttatttccctatggctgagccttgttgtgacacatcaagctt

SEQ ID NO: 386419 - DNA, 2842 bp, Homo sapiens
tgctgtttatttgttgtatattgccccctaggctggcagctgggtgtcactaactcctttcctctcccttattttcggccaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatataaagatatatagagatgcattcacagggttggctggagaggaagaccattctgtgaccaaaataccttggtcattttttttatattgccttatttccctatggctgagccttgttgtgacacatcaagctt

SEQ ID NO: 386420 - DNA, 620 bp, Homo sapiens
aaaaaagacaagtaactcttaggagaagcactaactcaaattagaaactacagtattgtgtccactcttactctgtgactgaagacacagtcacatgttttcagtgttaatatttcagagaagaacaggtgtcagtcctagaaggaattacacagaaggggggccctgttccctccagggtcaggtgtcaaagctggctgggaacctggacttcactcaatcggcccctttccttctgtccacaagcatctgcctgtggcttctactgcagacaactcacccccatactgtgccttctgtgccctataactggggagaaaagaatagaatgagggttctctcctgtatatccataatcttactgatgaactgatttgctgacttcaccaaatcgagaataaactggaatcaagatgttccctgctcttgagggataatagtctacaagacagttgtactactgcaaaaacacataacacaacttgcatctttttaatttcaggaaagagagaagtcataccaaaatataaaacaataaatcagaaataaaatctcatattcatgtatgatgctgtttacctttgatataccaaataaaactattaaaataatacaagaaa

SEQ ID NO: 386421 - DNA, 354 bp, Homo sapiens
gagagattgatttaaagaaaaataatgcttgactatctgaaataatattttaaccctatcataaaatctctgcctggtagaacagctgactgtggaagggtaaaatgcagagaaccagtcattggatctcccttctctactttgttactgaaatcttgaacctgtagaacattacttatcactgtgttcctttctaatgggaaaataataataaacacttgcagagtattttttaaaagtttttagctttaaaaaaaaaaaaccctgtgccttacacaatgtgtatattgagttgatactgattatgataattagatggtattatacaatcattcattcagcaaacattcactt

SEQ ID NO: 386422 - DNA, 412 bp, Homo sapiens
aaacccacctcctccttcaatgcctcttcagtgccctccacagttgtgccagctgacaaaggaaaagtagttaaagggcccagctccatcttcacagcacaggcaatgatgggcgaataaactgataactggcacagtttacccctttggctgcacagcttccatttgcacctttctacaacatctgaactcccatacaaaaacaaacaactggatgtctacctatcaagatagttatccttcttatgaaattctcacccttttgcccagagagccccaaccatcattctaccaatccctggctacaataacttctcaaagtcagtcacagtctcactgaatattctgttacctaaagactacattataaagctaactgtcaacaacttgtatagaaaagaatgggaaggag

SEQ ID NO: 386423 - DNA, 464 bp, Homo sapiens
gactcgtgggtgacccccagtcttggcttctgccgcacagaactgacagtgtggggaattagtggccaccctcctacctcaggtcctttgcacatgctgtggttctcgagtgctcagtgctgagatgaggaatgcatgggggcattgcagccctcgggcatggtgagatggatgggtgaaagggagagggccaggtgaacagagaccttggccacccactccctgtcactccaaactaacgcttcccagatgccaccctcagccctgcaccacctgacccactcactcagtagttgccccagctccacactgggtccctataagaccctgtcatatcccttcccgctgaggatcctcacatccctccttacctacttgggtccttggcattcctgggcggatctgcagacccccccacactgaccagtgacctcccaggaggggcgtcagctgcccaggtggtg

SEQ ID NO: 386424 - DNA, 2929 bp, Homo sapiens
cgggtacagggggcccaagagctgggctggctgtctcctgctcatccagccatgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccgacaaggatgggggcaccccagacagtgggcaggaactgaggggcaatctgacaggggcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagcgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctgaggccccagtaggggtggggagggagggagaggccgccacccccgccggtgtctgctgttctttccccataggtcttgctttgttgcctgtcttgctgtctagggatggacttggttcctcttgtcaaggtttgggaatgtcaaagccccctccccacacagggcctttcctgtcccttgtggggccttccaaccctgtcctttccactggtgggcggtgatgcttctaggtccttagaactgcccagaaactctgagtcccagcagctgggagccagaactttgcctgccctcccttggttccagtctctcttctctctctctgccttggaacctgaccatactttagttgtgcccttcccaggcatcatcctcctaccaccaacctggggccccatcttggaatgggggctccttggggccagcccagtgtggctcaccacactcttctttttttttttttttttttttggagatggagtcttgctctgttgcccaggctggagtccatttggcctgatgtcagctccctgaacctccgcctcctgggttcaagcgattctcctgcctcagcctcctgagtagctgggattacaggtgtgcaccaacacacccggctaatttttgtatttgtagaagaggcggggtttcaccatgttggccaggctggtgttgaactcctgacctcaagtgatctgcctgccttggcctcccaaagtgctgggattacaggtgtgagctgccacgcccagccccagtacactcttctctggaccagatctgtcccagtcctggatgcctcctcctactggtgccttcttttcttccagaggatttctctctccttcctcctcctttctttgggatccctgggttgccctgtcccaacctccttgttaggtgctttcccataggaggcccttcttgagaaacaataaactaggtagaactacccctatgcccatccactttcttgtgccacattctggcagggcccagatgcagctgggccttcctggcctggcagtgcctaggagaatttctcctgacctggcctggcctgtggctgatgttcagaacagccttgtggccgatgttcagaacagccttgtggccctggcgactccaagggttttatggcttttgagggacagagaggatggagggcttggggagccggaggacctaagtcctcatcctggcctaaaccccatgctccttgggaagtcaaaagcctggaaaatatctcctctggagccttcatctctgctatgccctctctccacaaagccccccttggagggagtccagtggtctttcctctgtgagccccagggcttcccagcctttgtcactctgagagctgctcttgttcagtttcttagaatggactgttttgcctgtagacggcccagctgcctgccctggcctgc

SEQ ID NO: 386425 - DNA, 514 bp, Homo sapiens
ctggccctctgggattttctggtcctctttttctgcctccctattgtcatcttcaacgagatcaccaagcagaggctactgggtgacgtttcttgtcgtgccgtgcccttcatggaggtgagtgtgtgttctgtttgagctctgctgggaggctgcaatccagggaagggactcaaagtctccatcaggtctttggaaatggaatttgtgggtgtgcaaaacctgagtcttggagctctgacttgctcctcctttaccttggagaaggagacaaatacggtattggtttctggttgctctcaagagaagtaggcaggccagggggacaggcgggtgtgtggggcccctgggttccagccccagcctgatcttctgcttcgggagcaacctcaaggcaggcctttgccactttctccagaccctaagctgccctctcccttcctcagcccttctcccctgtcccacccaagatacctctgtcctttgttgtgactcctcttctttcctctgtacc

SEQ ID NO: 386426 - DNA, 1293 bp, Homo sapiens
aggcggatccagccggccagctgcctctctggagcccagctcttgggccccctgcactcacctgctcttcctgggctggctgtctcctgctcatccagccatgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccgacaaggatgggggcaccccagacagtgggcaggaactgaggggcaatctgacaggggcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagcgcctggaactccatccttgccagccccagtacactcttctctggaccagatctgtcccagtcctggatgcctcctcctactggtgccttcttttcttccagaggatttctctctccttcctcctcctttctttgggatccctgggttgccctgtcccaacctccttgttaggtgctttcccataggaggcccttcttgagaaacaataaactaggtagaactacccctatgcccatccactttcttgtgccacattctggcagggcccagatgcagctgggccttcctggcctggcagtgcctaggagaatttctcctgacctggcctggcctgtggctgatgttcagaacagccttgtggccgatgttcagaacagccttgtggccctggcgactccaagggttttatggcttttgagggacagagaggatggagggcttggggagccggaggacctaagtcctcatcctggcctaaaccccatgctccttgggaagtcaaaagcctggaaaatatctcctctggagccttcatctctgctatgccctctctccacaaagccccccttggagggagtccagtggtctttcctctgtgagccccagggcttcccagcctttgtcactctgagagctgctcttgttcagtttcttagaatggactgttttgcctgtagacggcccagctgcctgccctggcctgc

SEQ ID NO: 386427 - DNA, 2969 bp, Homo sapiens
gctggtactggcccggaatcgttgggatagctcttgggccccctgcactcacctgctcttcctgggctggctgtctcctgctcatccagccatgcggtggctgtggcccctggctgtctctcttgctgtgattttggctgtggggctaagcagggtctctgggggtgcccccctgcacctgggcaggcacagagccgagacccaggagcagcagagccgatccaagaggggcaccgaggatgaggaggccaagggcgtgcagcagtatgtgcctgaggagtgggcggagtacccccggcccattcaccctgctggcctgcagccaaccaagcccttggtggccaccagccctaaccccgacaaggatgggggcaccccagacagtgggcaggaactgaggggcaatctgacaggggcaccagggcagaggctacagatccagaaccccctgtatccggtgaccgagagctcctacagtgcctatgccatcatgcttctggcgctggtggtgtttgcggtgggcattgtgggcaacctgtcggtcatgtgcatcgtgtggcacagctactacctgaagagcgcctggaactccatccttgccagcctggccctctgggattttctggtcctctttttctgcctccctattgtcatcttcaacgagatcaccaagcagaggctactgggtgacgtttcttgtcgtgccgtgcccttcatggaggtctcctctctgggagtcacgactttcagcctctgtgccctgggcattgaccgcttccacgtggccaccagcaccctgcccaaggtgaggcccatcgagcggtgccaatccatcctggccaagttggctgtcatctgggtgggctccatgacgctggctgtgcctgagctcctgctgtggcagctggcacaggagcctgcccccaccatgggcaccctggactcatgcatcatgaaaccctcagccagcctgcccgagtccctgtattcactggtgatgacctaccagaacgcccgcatgtggtggtactttggctgctacttctgcctgcccatcctcttcacagtcacctgccagctggtgacatggcgggtgcgaggccctccagggaggaagtcagagtgcagggccagcaagcacgagcagtgtgagagccagctcaacagcaccgtggtgggcctgaccgtggtctacgccttctgcaccctcccagagaacgtctgcaacatcgtggtggcctacctctccaccgagctgacccgccagaccctggacctcctgggcctcatcaaccagttctccaccttcttcaagggcgccatcaccccagtgctgctcctttgcatctgcaggccgctgggccaggccttcctggactgctgctgctgctgctgctgtgaggagtgcggcggggcttcggaggcctctgctgccaatgggtcggacaacaagctcaagaccgaggtgtcctcttccatctacttccacaagcccagggagtcacccccactcctgcccctgggcacaccttgctgaggccccagtaggggtggggagggagggagaggccgccacccccgccggtgtctgctgttctttccccataggtcttgctttgttgcctgtcttgctgtctagggatggacttggttcctcttgtcaaggtttgggaatgtcaaagccccctccccacacagggcctttcctgtcccttgtggggccttccaaccctgtcctttccactggtgggcggtgatgcttctaggtccttagaactgcccagaaactctgagtcccagcagctgggagccagaactttgcctgccctcccttggttccagtctctcttctctctctctgccttggaacctgaccatactttagttgtgcccttcccaggcatcatcctcctaccaccaacctggggccccatcttggaatgggggctccttggggccagcccagtgtggctcaccacactcttctttttttttttttttttttttggagatggagtcttgctctgttgcccaggctggagtccatttggcctgatgtcagctccctgaacctccgcctcctgggttcaagcgattctcctgcctcagcctcctgagtagctgggattacaggtgtgcaccaacacacccggctaatttttgtatttgtagaagaggcggggtttcaccatgttggccaggctggtgttgaactcctgacctcaagtgatctgcctgccttggcctcccaaagtgctgggattacaggtgtgagctgccacgcccagccccagtacactcttctctggaccagatctgtcccagtcctggatgcctcctcctactggtgccttcttttcttccagaggatttctctctccttcctcctcctttctttgggatccctgggttgccctgtcccaacctccttgttaggtgctttcccataggaggcccttcttgagaaacaataaactaggtagaactacccctatgcccatccactttcttgtgccacattctggcagggcccagatgcagctgggccttcctggcctggcagtgcctaggagaatttctcctgacctggcctggcctgtggctgatgttcagaacagccttgtggccgatgttcagaacagccttgtggccctggcgactccaagggttttatggcttttgagggacagagaggatggagggcttggggagccggaggacctaagtcctcatcctggcctaaaccccatgctccttgggaagtcaaaagcctggaaaatatctcctctggagccttcatctctgctatgccctctctccacaaagccccccttggagggagtccagtggtctttcctctgtgagccccagggcttcccagcctttgtcactctgagagctgctcttgttcagtttcttagaatggactgttttgcctgtagacggcccagctgcctgccctggcctgc

SEQ ID NO: 386428 - DNA, 339 bp, Homo sapiens
tgagagatcaagcctctttcccaaaacacatgactaagttagtaagaaaaagaatattttggtacataacagtatgaaacagaaaaaagtacataactgaaacaatgtaacttctccacacatctgtggaacagcacttaatcaggaacccttaagtatttagggaattgaaacttaaaatcagtcctatttattgaagattggtaagacaaacaaaactctaaaatagaatgtaaactaattaaatattattacatgaattaaatttatacagctttgcaggatcatacgtatgtcttaagatgtgtttcaggcttcattttgactgggcctttccat

SEQ ID NO: 386429 - DNA, 132 bp, Homo sapiens
tacttaaaggagggtgataagaaatacgtgtggcataggctggggaggaaaagagagctaagcgatcattttctaaagtggaaaattcagcgataatacctaaaactaaacactccacaggcagcaatttaa

SEQ ID NO: 386430 - DNA, 243 bp, Homo sapiens
agaagacaatgaaaacacacatcatattaccgctccagagatgctgtgaacatttttatgtattaggaaatagatatttatagtcattagtatagtatgtaaaaatgagagcctattaaaacgtgcagcagtgacctatagaaaccaaaggtaaaaaaaaatctgtgtttgaaatctgtttgttgcctgtccaagtgctcactgcagctccccagtgtgttatggagcacaggttcttaaaac

SEQ ID NO: 386431 - DNA, 466 bp, Homo sapiens
agaccctcagattgaagagatcatttaaagacgaagatgataaaggaaaagccacacttagacaaattacagtacaatttaggacctcaaagacaaacaaaaaatcctaaaagttgatagagaaaaggcggattgcataaaaaagaaagaagcagcaaatttctatcagaattcaaaaaaataaacaactggaagcaagaagactatcgtgtcttttcaaagaattaaaggaaaagaaatctgaacttagaatgatatgtccaaactgtcatccaaagatcagagcataataaaaaatattctcagaaatacaaagcatcagcagctgagaccttcactgaaaatagtttttgatgaagtactaaaataagagattattaaaatccgggagaatgagaagacagaataatacctaatgtattttacctgataaagtttgttatctataaaataaatatctaagacc

SEQ ID NO: 386432 - DNA, 188 bp, Homo sapiens
agtgggatggggacacagacgaggaaagagagagaaaacagaaaatgcagagaaggagtgtgacaggcctgaggcaccaagagaactccagtctagctggagtgtggtgtgaggtgaagcaggggacaggcagctgttggagggccttcaaagccagaggaggggttttggattttatgtgaaggaca

SEQ ID NO: 386433 - DNA, 415 bp, Homo sapiens
caaatagatggcctattttggggttttaccttgtgactgtgtgagtcaatactctttaataagctttccttcacatatacacctatcctgttagttctgtccctctagaaaaccctaatatacttcccaactaattttatgaattcatcattactctgatacaaaacaatataaagacattacaaataaatgaaactacacaccaatatttcttatgaatactcacacaaaaattctcaaaatattggctaattgaattcagtaatatattaaaaatgcaaaagtacaatgaggaaatgaggtttatattgaaaattcagggttccttcacatttgcatgttatatgataatctcagtaaatgagaaaaaaagcatttaataagattcaacatccattaatattaaaatctctca

SEQ ID NO: 386434 - DNA, 877 bp, Homo sapiens
  misc_feature (877)..(877): n is a, c, g, or t
cgcctcagtgagccgagcagaggggccgcctccgcccgcacccagcatgcttcgccgaggctataaggcctctgaaaggcgaagacacttgagcgagaggctcagctggcaccaagaccaggcgctgagtagcagcatctacctcctacgagagatgggccccactggcttcctgctgagggaggaggagccggaatacatggatttccgagtttttctaggaaatcctcacgtttgtaactgttccacatttccgaaaggaggggaactttgtaagcatatctgctgggtcttgttgaaaaaattcaagcttccaaggaaccatgaatctgctttacaactgggtcttggagaaagagagataagtgacttgcttcgggggatacatcgagttcaaactccccaaccaggaacaaatgacgaaaatgaacatgttgaagaagatgggtacattaaacagaaggaaattgattcagaggatatctgctctatttgtcaagagctacttttagagaaaaagcttcctgtcaccttttgcaggtttggctgtggcaatagtattcatataaaatgcatgaagatcttagctaattatcagagtacatcaaacacttccatgttgaaatgtcctctgtgcaggaaagagtttgcaccattaaaactgattttggaggaattcaaaaactctagcaaactagtagctgcagcagaaaacagagagactggacaaacacctcggggattctctgttattacttgcaaacagtttcccaattgagggggaagtggtataagtgtaccggaatgctttgaatattcttatggcagaatgttcggaagcaacgggcatctttccaccgtttaaattctgggaacn

SEQ ID NO: 386435 - DNA, 434 bp, Homo sapiens
aagaacctcagccttctttccctactcagctcctcagaagcccagcagcccagaaataccctcccggaatgaaatgagaagaggcagttttctccctgagcaatgtttttcaaactttttgacccaaaagcccacagtaaggaatacatttgatttcataactaaaacccacaaataaatataaatacataacagaaacaaaatttcaggaaaaaaaccactcatcactactatgggcaaggcattttgatatctactgctctgtttcacttaaaaaaaaaatgtgggccaggagtggtggctcatgcctataatcacaacactttgggaggctgaggtgggagaattgctcaaccctgggaggttgtggctgcagtgagttgtgatcatcccactgcactccagcctgggtgacagagtgacattctgtctca

SEQ ID NO: 386436 - DNA, 1477 bp, Homo sapiens
ggcacgagcgcttagagggagctgtgttttggtgacctctgaaactcagtactgcagcgaatgagctcctgaccttgaggagtacttaacagaattatgtctcgaagaatcattgtgggaacccttcaaagaacccagcgaaacatgaattctggaatctcgcaagtcttccagagggaactcacctgccccatctgcatgaactacttcatagacccggtcaccatagactgtgggcacagcttttgcaggccctgtttctacctcaactggcaagacatcccaattcttactcagtgctttgaatgcataaagacaatacagcagagaaacctcaaaactaacattcgattgaagaagatggcttcccttgccagaaaagccagtctctggctattcctgagctctgaggagcaaatgtgtggcattcacagggagacaaagaagatgttctgtgaagtggacaggagcctgctctgtttgctgtgctccagctctcaggagcaccggtatcacagacactgtcccgctgagtgggctgctgaggaacactgggagaagctgttaaagaaaatgcagtctttatgggaaaaagcttgtgaaaatcagagaaacctgaatgtggaaaccaccagaatcagccactggaaggctttggagacatattatacgcttttggagacatattatacagaggagtgagtccgtgctgctgcacatgccccagcctctgaatctagcgctcagggcagggcccatcactggactgagggacaggctcaaccaattctgagtggatattactctgcatcacaaatgaagccaacagtcatatcttccgatgtggagatttgagaagcatttgtattggatgtgaccgtcaaaatccgccccatatcactgcaacacctacaagttttcttgcatggggtgctcagactttcacctctggcaaatattactgggaggtccatgtgggggactcttggaattgggcttttggtgtctgtaataagtattggaaagggaagaatcagaatggcaatatatatggagaggagggactctttagtcttgggtgtgttaagaacgacattcagtgcagtctctttaccacctccccaattacactgcagtatgtcccaagacctaccaaccatgtagaattattcctggattgtgaagctagaactgtgagcttcgttgatgttagtcaaagctcccctatatacaccatccctaattgctccttctcacctcctctcagacctatctttttctgtattctcctctgaccagagacaaatcagaaatgtgttcatctgctgtgggaacccctttatcccagaaagccctcttccttgtgccttatcaaacaggacaaataggttcggttttatgtcttgaattgcattctaatgttattaaaactcatttattgtgttactattaaatgtagtaaaaacactaaaagtat

SEQ ID NO: 386437 - DNA, 322 bp, Homo sapiens
aaatgccatttactagggacttatttgtctctcattctgggccccctcccaatgaaacggtctgtatgttactttattgtcttcactggtgcttcaatttatggctcttttgcaggagaagctgttaaagaaaatgcagtctttatgggaaaaagcttgtgaaaatcagagaaacctgaatgtggaaaccaccagaatcagccactggaaggctttggagacatattatactgtaataccctaccttctccaggaacttatggtgggcaaatgggtgactcttaaaataggaacttgatatcaaaccgtaatgtttctggga

SEQ ID NO: 386438 - DNA, 1245 bp, Homo sapiens
ggcacgagcgcttagagggagctgtgttttggtgacctctgaaactcagtactgcagcgaatgagctcctgaccttgaggagtacttaacagaattatgtctcgaagaatcattgtgggaacccttcaaagaacccagcgaaacatgaattctggaatctcgcaagtcttccagagggaactcacctgccccatctgcatgaactacttcatagacccggtcaccatagactgtgggcacagcttttgcaggccctgtttctacctcaactggcaagacatcccaattcttactcagtgctttgaatgcataaagacaatacagcagagaaacctcaaaactaacattcgattgaagaagatggcttcccttgccagaaaagccagtctctggctattcctgagctctgaggagcaaatgtgtggcattcacagggagacaaagaagatgttctgtgaagtggacaggagcctgctctgtttgctgtgctccagctctcaggagcaccggtatcacagacactgtcccgctgagtgggctgctgaggaacactgggagaagctgttaaagaaaatgcagtctttatgggaaaaagcttgtgaaaatcagagaaacctgaatgtggaaaccaccagaatcagccactggaaggctttggagacatattatacaggagtgagtccgtgctgctgcacatgccccagcctctgaatctagcgctcagggcagggcccatcactggactgagggacaggctcaaccaattctgagtggatattactctgcatcacaaatgaagccaacagtcatatcttccgatgtggagatttgagaagcatttgtattggatgtgaccgtcaaaatccgccccatatcactgcaacacctacaagttttcttgcatggggtgctcagactttcacctctggcaaatattactgggaggtccatgtgggggactcttggaattgggcttttggtgtctgtaataagtattggaaagggaagaatcagaatggcaatatatatggagaggagggactctttagtcttgggtgtgttaagaacgacaaatcagaaatgtgttcatctgctgtgggaacccctttatcccagaaagccctcttccttgtgccttatcaaacaggacaaataggttcggttttatgtcttgaattgcattctaatgttattaaaactcatttattgtgttactattaaatgtagtaaaaacactaaaagtat

SEQ ID NO: 386439 - DNA, 734 bp, Homo sapiens
cacagtcctcttgccttcgtgtcgaccaaagtgctgggattataggtgaaagccaccatgcccggctcttccttttttactcactgcatcagaaaactttcttgtctctgttaacaaagtgtattctaaatctcactcttttcctcctgccttggcctcctgagtctctgggattataggcacgaaccacaatgcctggcacttcttcctttaaaaaataacttgattaaggtacaattgacatacaataagtgggatatatttaaagagtaaaatttgataagttttgataggtgtatatatccatgaaatcaccaccacaatcagcagagtgaatatatcaatttctcacaaaagtttccacatgacttttcataattcctctccctttcctccctgtcccctcaacactcattacccccggaattcccaatctactttctgtcactatatatcagacagcatcttctagagttttacagtacatagagttttatagaatcatatagtatgtacttttttttctggcttctttcactcagcataattattctgagattcatccatgttgttgtttgcatcaatattttactcttttttattgctaatattctactgtgtggatttaccgcaattaatttatccatttactctttgatggacgtttaagttgtttccagcttttggctattaaaaataaagctgttatgaacatttggatacgaatctttgaa

SEQ ID NO: 386440 - DNA, 787 bp, Homo sapiens
ctagcaggactccccctgcagttcttcacatttcagagggtctgggcaacatccacatggcagcagtaggatccaggcatccacaagagaagaccaagccttatccaaggaggaagagatggagaccgagtcagatgcagaggtagcatgtgacctgagcaatatggaaatcaccgaagagctccgccagtactttgcagagacagagaggcacagagaagaactactgcggcggcaacagctggatgcggagcgcctgaacagctacgtgaacgctgaacacgacctgtactgcaacacccgccggtcggtagaggccccagctgagaggcctggtgagcggcgccaggccgaaatgaagcgtttgtactgggacagcgccgccaagatccaggccatggaggctaacgtgcagctgagctttgacaagcactgtgatccaaagcagcctaattactggccggtcatccccccgaagttctgagctcggggcacagggcacccagcctcttcctcttccttttggatacgcgctcttcatctctccttctgtacatttctcagggaaaggggactttgtactgaggtacaggcacgttcaccacagtcccagtgggcctgtcacggggtggatgtactgtgccagccacttggaggtcggcaggacatattctgttgccaacatgataaattttatcctggacataaaatgataattttgtatatattatactggttttttatgttgtcagtaacagttcaattcattaaagttcttgcctagaga

SEQ ID NO: 386441 - DNA, 725 bp, Homo sapiens
ctgacggggaaggaaggtaaaaaaggagcgctaaagattggcgggggttgtgggaaagcaagccgagtgtacgggaagggccggctgcggcccgccatgtttgaacctggcaagagcgaaagaagccggttggaatgccttcttcctgcccaaactaataaaaccgcatgcctaccttttgcttagtattggctagggatgactaatcataacatttgtaagtacttacggggtttcctccatggagacacagaagtctgggacgtttctagaagcctgtggcaaatttgaaaagcaagatacaaaatagcgtatggagtctgattatcgctatgtcaataaattttcttaaaggacaaagcactgaaataaaatggaaataataattcttttaaaaaatttttaaattatttttatagagatgggggttttgccatgttgcccaagcaggtctccaactcctggactcaagcgatccccccacccccagccccgtctccgcctcccaaagtgttaggatcacaggcgtgagccaatgcgacccgcctggaaagaattctaaaacatggcctgcttggccaccgcccaggatctgcaagctgcgcgcccacaagtttcggcacccatttggactttcacaatcggagatggcagtggtgaaggcatcaacatcaaaagctaccaggccttggtattctcatccagtatatgcaagatactggcaa

SEQ ID NO: 386442 - DNA, 467 bp, Homo sapiens
ctgacggggaaggaaggtaaaaaaggagcgctaaagattggcgggggttgtgggaaagcaagccgagtatccaggccatggaggctaacgtgcagctgagctttgacaagcactgtgatccaaagcagcctaattactggccggtcatccccccgaagttctgagctcggggcacagggcacccagcctcttcctcttccttttggatacgcgctcttcatctctccttctgtacatttctcagggaaaggggactttgtactgaggtacaggcacgttcaccacagtcccagtgggcctgtcacggggtggatgtactgtgccagccacttggaggtcggcaggacatattctgttgccaacatgataaattttatcctggacataaaatgataattttgtatatattatactggttttttatgttgtcagtaacagttcaattcattaaagttcttgcctagaga

SEQ ID NO: 386443 - DNA, 505 bp, Homo sapiens
cttatgtctgctctgcaggcctcctccggattcactgccttatcccaaacatgagatctccctgtgccctgctccatcgtggtgacgctcacacctgggagctgcccaacacggatccaaacatgagctctccctgtgccctgctccatcgtggtgatgctcacacctggagctgcccaacacggatctagcaccatttggggtttgtgcaggttctggcgcctctgctctggactggggtcagtcccgtgtgtgttttccatgggggagcactggacaagaggctcagccacaccactgctgggatgtggtctggagtgtattcacttcggtcccatctgcccaagcacagccactgctgagctcagaatccccggtgtggggaagtgttcctctgtcataggcagagcaaggcagtgtggaactggctacgtggtaatgcggtccacccctccatctcctcttaatcttatcttttaggtagaaaatgtcagagactttaagt

SEQ ID NO: 386444 - DNA, 543 bp, Homo sapiens
ctgattgaatgcacgtatcctaatatttcatcatgtgtctgtattaaaatttacttcacttttcccgtacttcttagacactcatttacacctgatattttgttgttctaaataagcctgactctcttattataataagtggaaggaaagagagggagttgctccacccttcctgggccatccacccagccatcttctctaggtccccgcttccctccaccgcacacagccccaccttaggccaccacatgctttgtggagggtcactacttgcaccctctgagccgtctggttatggtccctcagaaagatgcccctgcatccttattgtccacccgccgaaggctggcagtgggacagaccccacctcccattctgctccttctttcagttccctgcaaacctactgctctaggctctatgagtgcatcaaacattcctgaaggcttgtgtctaacaaaagaatttttggtgtaagaaaatattttaaattgtgtacaaaatgtgtcctcttctatagctcaaggggacataaaaaaaaaa

SEQ ID NO: 386445 - DNA, 242 bp, Homo sapiens
tagatgcctggggcagggcctagcaattcgtgtttttcacaatcaccctaggtgaacatgactaccagacctgtgtcttacctaccctctcccgcctccagggctacaaggcaccagaccagtgggtcctggccgctggcccctgagaggcagggcaggagctgtgtgcccctagaagcatgtgccagggggaacttgggccctggagcagctggggcagcaggtggggagaaggagggtag

SEQ ID NO: 386446 - DNA, 330 bp, Homo sapiens
atttacagctcatcatttttctctgcctagaggaattcctttttaatatttcttatagtatagatctgctggtgatggattgtttcagcttattatgtcagaaaaagtttttctgtcactttcattttgaaaggtatttttactgggtaaagaaaaagttaaagaaaagatttttttttaatttcagttctttaaaggtgctattctagtgtcttctggcttacattgtttccaacaagaaatatactcttatttttatcttagttcctctgtatgtaatatgtctttttttcctggatgctcttaagagtttgtctttatcattgattt

SEQ ID NO: 386447 - DNA, 169 bp, Homo sapiens
aataataataaatttattattgaatttttagaggtctttatatactctggatacaggtgctttattacatatgtactttgcaaatattttcttcaagtctgtgacttgtctttttcaaagagcagaagttattaattttgaagatttattatgtttattttattattat

SEQ ID NO: 386448 - DNA, 229 bp, Homo sapiens
gggtgggtggtgcggcaggtgctgtggaaagagtcctgggcgttgagaagggaggtccaggcttgggcttggctagacccactgtgtgaccctagacaagctactctgcctctcaggttctccgcttccacctaccaaacagggacgcaggccagctctttgctaatggtagcaatcatgaggcgtgtcattcatatcctgctctccccggccttcctccaaacccgtt

SEQ ID NO: 386449 - DNA, 719 bp, Homo sapiens
taccggaatctcactctgttgcccaggctggagttcagtggtgccatcttgggtcactgcaaactctgcctcccaggttcaagtgattctcctgcctcagcctcctgagtagctgagaaagaattgcttgaacccgggatgcggaagtcactgcactccagcctgggtgacagagcgagactctgtctcaaaaaagaaagaaatacattggcagcccattcagagggcccagagatctgtgtcttgcttcaacagtgtttggacggaactgatccagggactctctttcttccagcctctgaccaccttgggatctcctctccacttgcaatctccgggaccatcttcttggccatcttctgcttctgggaccagccaacaccgtttttgtggttagctccttcttgccaaccaaccatgagctcccagattcatcaaaattattccacggagggtgaggctaccatcaaccgcctggtcaatttgcacctgcgggcctcctacatctgcctctgtctgggcttctattcccaccgtgataatgtgtctctggaaggcatgggtcactttggcgaattggctgaggagaagcgccagggcacagagcgtttcctgaaaatgcaaagccaacacggcagctgcgctctcttccatgacatccagatgccggctcaagatgagtacggataaaaccctggacgcgacggaagccaccatag

SEQ ID NO: 386450 - DNA, 298 bp, Homo sapiens
ttgttccattttgtagattggtatcatcatctccctgagaaacctttactacaattaagggaggagaccacccctcatattgtcttatgcccaatttctgcctccaaaggaagaagaagtaaaaactaaaaggcagaaatgaaatccacaggcagacagcccggcgtgctgcgccctgggcctggtaaagatcaacccctgaccgattccagacattgtatggaaaagcattgtgaaaatccctgtcctgttctgttctgattacctgtgcttgcagccccctgttacgtaccccctg

SEQ ID NO: 386451 - DNA, 388 bp, Homo sapiens
cttcagcctgggtgacagaaagagactctgtcttaaaaaaaaaaaaaaagaagaagaagaaaaagaaaaaagaaaagaaagggagtgaagccgagtaaggaagaagaaagaggcaattgaaaatgtggtcttagatcaatcaagtctagtcttggtctgatgcagggaggctcttgagtctaaactacactgcaagggcattctgctatattataagggtgctgaatatccttcctgggtggagtggcttccagtaacccagggacattttctggaggaagggtgcagctgtgaactcttagctgccaacacttgcagcagccaagggatgggtgggtacatcagatccacccatctggataaaaaggtaacctggtgttatgctgaa

SEQ ID NO: 386452 - DNA, 2514 bp, Homo sapiens
cggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgtcctgctgctgctgctgctgctcgtcgcgccggggcagccagctcaatgtgagcgagctgacgccgtccagccatgccagtgcgctccggcagcagtacgcgcagcagtccgcgcagcagtcggcgtccgcctcccagtaccaccagtgccacagcctgcagcccgccgccagccccacgggcagcctcggcagtctgggctccgcgcccccgctctcgcaccaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctccacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggcgtcgctgtattccttagctctgaaatgccttatcagtctctccacgatcatcctgctcggtctgatcatcgtgtaccacgccagggaaatacagttgttcatggtggacaatggagcagatgactggagaatagccatgacttatgagcgtattttcttcatctgcttggaaatactggtgtgtgctattcatcccatacctgggaattatacattcacatggacggcccggcttgccttctcctatgccccatccacaaccaccgctgatgtggatattattttatctataccaatgttcttaagactctatctgattgccagagtcatgcttttacatagcaaacttttcactgatgcctcctctagaagcattggagcacttaataagataaacttcaatacacgttttgttatgaagactttaatgactatatgcccaggaactgtactcttggtttttagtatctcattatggataattgccgcatggactgtccgagcttgtgaaaggtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaaatttctgcaca

SEQ ID NO: 386453 - DNA, 1488 bp, Homo sapiens
aaaacgtacggctaggtacgaggctgggtggtgcttcacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaaatttctgcaca

SEQ ID NO: 386454 - DNA, 2095 bp, Homo sapiens
cggcggcagcagcccatgcctccggtgcaacagctgcgcctcctccggtgccccggcggcgggggcgggagataacctgtccctgctgctccgcacctcctcgcccggcggcgccttccggacccgcacctcctcgccgctgtcgggctcgtcctgctgctgctgctgctgctcgtcgcgccggggcagccagctcaatgtgagcgagctgacgccgtccagccatgccagtgcgctccggcagcagtacgcgcagcagtccgcgcagcagtcggcgtccgcctcccagtaccaccagtgccacagcctgcagcccgccgccagccccacgggcagcctcggcagtctgggctccgcgcccccgctctcgcaccaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctccacgagatggactcagaggcgcagcccctgcagccccccgcgtctgtcggaggaggtggcggcgcgtcctccccgtctgcagccgctgccgccgccgccgctgtttcgtcctcagcccccgagatcgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccggcgcgccctgttcgaaaagcgcaagcggctcagcgactacgcgctcatcttcggcatgttcggcatcgtggtcatggtcatcgagaccgagctgtcgtggggcgcctacgacaaggcgtcgctgtattccttagctctgaaatgccttatcagtctctccacgatcatcctgctcggtctgatcatcgtgtaccacgccagggaaatacaggtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggagcagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctagaagagaataagttaaccacaaaataagactttttgccatcatatggtcaatattttagcttttattgtaaagcccctatggttctaatcagcgttatccgggttctgatgtcagaatcctgggaacctgaacactaagttttaggccaaaatgagtgaaaactctttttttttctttcagatgcacagggaatgcacctattattgctatatagattgttcctcctgtaatttcactaactttttattcatgcacttcaaacaaactttactactacattatatgatatataataaaaaaagttaaatttctgcaca

SEQ ID NO: 386455 - DNA, 1032 bp, Homo sapiens
agaatctgtctaaaaaaaaaaaaaaaaaaaaaaaacaaaacaaagaggaaactcaggtggcaatttcatagaagaaagaataaggaaatatctttataatacagaacatggataatatcaatgagagtttacccataagaagagagtccccttgctgtgtagggaaatactaagaacaagtcagagagctgatggatgaaagccttaacctctggggagataaaagaaagaagcttggaaatacaggaggccaaagatagcagtcttgagatggtatatgagggaagcagaaattaatattagaacctgggtacaggacagattctgaaagtgaatagtattacataaagcttggtaggaaaatcgcactagttcaccagtaatggatccaaaccaagaagaaatccctgatttacctgaaaaagagttcacgaagttagttattaagctaatcagggagggaccagagaaagacaaagcccaatgcaaggaaatccaaaatatgatacaagaagtgaagggggaaatagtcaagggaataaagaaaaaaccatcaaaaattcaggaaattttggacacgcttttagaaatgcaaaatgctccggaaagtctcagtaatagagctgaacaagtagaagaaggaaattcagagctcgaagataagttcttctaattaactcaatccaacaaagacaaaaaaaaaaaaaagaataagactatatgaagaaagcctccaagaagtctgtgattatgttaaacaaccaaatctaagaatagttggtgtacctgaggaagaagagaattctaaaagcctggaaaacatatttgggggaataatcgaggaaaacttccctggccttgatatccaagatgctagagacctagatatccaaaaacaagaagcacaaagaacacctgggaaattcatagcaaaacaatcttcgcctaggcacattgtcatcaggttatccaaagttaagacgaaggaaagactcgtaagagctgtgagacagaagcaccaggtaacctgta

SEQ ID NO: 386456 - DNA, 385 bp, Homo sapiens
ttacattttacatttaggtctacagtcaattttaaattaattttgtataaggcgtgaggtattggttgagatgctttcttttttttttctttttgtgtatggacattcagttgttccagttctctatgttgacaagactatcctttcttcactgaattgcctttgtaacttctgaaaacatcagttgactatatttgcatggatctgtttctggattctctgttttgtttattgatccatacatacacctcttcacccattccatgctgtcttgatcactgtagcttgatagtaagtcttgacatggggtgatgtgagtcctccaattttttttttaaaggttgtttttagctatgttcctttgcctttctatatacattttaga

SEQ ID NO: 386457 - DNA, 729 bp, Homo sapiens
aggtttggtaaacccaagggttgggtattcgggggccccccccggaggttaacctaattttgggaaggcttaaggaatgaaatgggtgtagggtggtgggaccatgtggggcttgttggcctgtaatatttagccagagtttactttctaaggggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtatttta

SEQ ID NO: 386458 - DNA, 1914 bp, Homo sapiens
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386459 - DNA, 1941 bp, Homo sapiens
  misc_feature (21)..(21): n is a, c, g, or t
cccactactttctgcgagaanacgacagaatggtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaagagtctctgctggtagccactacagctgtgaatgtgctgtgtcatacctgaagccaatatgtctcggagtttcacctgaggcccatgatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386460 - DNA, 1780 bp, Homo sapiens
ggaacgccaaccgcctgggcctagcgcagcttcctccgcccaccacggaagtgaggcggggatactaaagcgacggagcccggtggacggaagtgggtgttggaggctttaagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386461 - DNA, 1786 bp, Homo sapiens
  misc_feature (21)..(21): n is a, c, g, or t
cccactactttctgcgagaanacgacagaatggtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatgctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386462 - DNA, 1799 bp, Homo sapiens
gctcgttctcgttgggggaaaccgtccagacgcacttgctgcccattctttacatcctgggggtgaatccctgaggggcctctccttgctgaagagtagcctggagctggacggagactgacccgccacgtttccagccgccgcgagtctgctcaggaactctgggctctttgcttcgcgaaatgtaaaaatgcaaaaaggcaaacacaaaaactcccataaacttatgttatttctatttttctttctagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386463 - DNA, 774 bp, Homo sapiens
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggaacttaagcggatcagcgggtaccgagct

SEQ ID NO: 386464 - DNA, 693 bp, Homo sapiens
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacataggatctgaaaccaaacaacttgttgctaggtgaataggcctattcacatgagggtggaaccaggtggtatcgtctccccggtttctatttgagctagaattatagg

SEQ ID NO: 386465 - DNA, 269 bp, Homo sapiens
ccaccgtttacaaggccagagataagaataccaaccaaattgtcgccattaagaaagtgagttacctttttatgttgtttttaagtctccttgaagatgtctgtattattaattgactgatagccattttattagtcttgaccatactctgataatgagttactcatgtcattttcagagacaaaataattaattagtgctttgtgttcccaaacggaactctagggttgaacccgttttaatttctattgaaatgaagaagaagctgt

SEQ ID NO: 386466 - DNA, 1383 bp, Homo sapiens
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtatttta

SEQ ID NO: 386467 - DNA, 1323 bp, Homo sapiens
  misc_feature (21)..(21): n is a, c, g, or t
cccactactttctgcgagaanacgacagaatggtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtatttta

SEQ ID NO: 386468 - DNA, 1918 bp, Homo sapiens
gctcgttctcgttgggggaaaccgtccagacgcacttgctgcccattctttacatcctgggggtgaatccctgaggggcctctccttgctgaagagtagcctggagctggacggagactgacccgccacgtttccagccgccgcgagtctgctcaggaactctgggctctttgcttcgcgaaatgtaaaaatgcaaaaaggcaaacacaaaaactcccataaacttatgttatttctatttttctttctagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386469 - DNA, 1578 bp, Homo sapiens
gggcttcctgaggaaacttagataacctcttttgagagtctcctgtattgatacttacattttaagtctgtaaattgttttatgtggtagagtttatttgaaataataaagggtacctgtatattgtatacttgctttacaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttaaaaacaaacagaaacgcccacacacacccaccccaacacccccaagccgcggggcccccccccccaaggcgcccgcgcccccactacagcggtcacacgctcacacacccgcaggggcacgcagagaccgaaaccacagaaccaaggcacggcgggtacaccaataacaagcagggggaccacaagcgcacggggctcacctgacacacagggccaccagcaactcgcccgcagggcgacaacaagccccagcacccagcaagtctgcgggaacaggaacccacagcaaaggatagcgtagcccacgcagcaggagagtgcagaggcacgggtgaataagtcggacgagtaaactaacacacacgcgccgccaggcaaccagaaagagcgaggccgaagacccaccagaga

SEQ ID NO: 386470 - DNA, 1103 bp, Homo sapiens
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaataccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaaggtctttttggccggagatcgaactgtcagtacagattttgacttgggccccattggggacgtggcggcatggtgtcttccgatttgtgaacttaagttccggaacctgggccccttccggcgggagatcgactcaaggggttcttatcggtcgctatgcccggcggagagatttttgtcgggccgttgttgtcgcctctcggcttgcacaccgcgggaaaaaaagcgcggcgtctgcgcggggcgtgcctgtccgctccgtctccgctctcctcttctcttttgcttttggggtgc

SEQ ID NO: 386471 - DNA, 598 bp, Homo sapiens
attttgctggcctaattttctgtactgaacagtaaacattccttctactagagtttaatacactaatgctttggggatgactagcatgaagagaaattccacaatttttgaaacagaaattctatttttctatcttctttaatgtcaaatcaacattttttagttagtaaaaccaaagaatatcaaacaatgagagtcctttctagctaagattttggagtcacaaataaagctacatcctaaaaagccaaaaggaaaggaaaaaaaaatcaacccctgcatttatcaaggtgctttaaatacccaaagacacctctgaactgggttttgttgatgggtgcttgttgtgtgcccagtgtaattttttaataaatattttcctgtgctatgaatgtttccatttttataaggagaaagctgactttgaaatgcagtgggaaacaggatttgccaagaaaaaatgccagtaggataaagcccaattttattattaataatataggtttatttgtatatcatacaaactgctaagagtctcttcttcgatgtgaattcctgtattatcaggacacagtcaaatccacttgtaagaaaattt

SEQ ID NO: 386472 - DNA, 730 bp, Homo sapiens
tttattgtagaccaaaacaacttttcttcgtacttcaagaaagacgtttgtatacatgttactacagcctatggtttcgttcttctgtggaccttataattataatacattgttttcagaactcagtatatcatgttaactaagtgctctgatgctttaataagcattattaaatactaattaatgtaaaaaggaacctcttactcttctgtaattatagctctaaaatcactggaattagatgattatcagctttcacgtaaaaaaaaactgtctatagaaacaagttttaagaacttcaaagattgttgggtaatgcagcactttactgtgcagccaaaatttgaaaacatctcaaaattctttggactgttagaattggtatgtttaggaaggtagactattgggtcaaagatgaaaatataaatgtgatgtattgtcaaaactgctattgtcagccatggctcaatgtagattatcccactcatttttatcagttctgtaagaatgccatgtatcagattctttatagaggtatgattaactgtggctttttctgtcactttactctacattaaataaaatatagggggccctagccagaacagtcaggcagacaaaaaagatagaaggcattcagattggaaaggaagaagtaaagttgtctctgttttcagatgagatgatcttatgcatagaaatacctaaggattccacacacaaaaaaaaa

SEQ ID NO: 386473 - DNA, 311 bp, Homo sapiens
cacctattcatccacctatcattcatccatccacccatcattccatccatcccccattcatccatccagccacctaccaaccctgcatctacctacccattcatccattcatctgtctatccacccaccatgtatccatctaatcttattcaaggagctacagcatgcgggaccatgctcagcaatgtaaagacaacgattaacagttcaatcatagttcctgtcccaaatggactcccatctactgcagtttgtacccagggatgtggaggaaaccctggtccccaaatcagaaggaatgaccccagcct

SEQ ID NO: 386474 - DNA, 158 bp, Homo sapiens
aatgccattatcatgggagtgggtttgttgtgagagtgaaatcagcccttcctcactgtctcaccacaaggtgccttctgccatgtgataaggcagcgagaagcccttgccggatgcagctccttaacctgggacttcccagcctccagaagcataag

SEQ ID NO: 386475 - DNA, 519 bp, Homo sapiens
ggcattttagaagataaaatcccatacaaatgatatatgctatatttatgttggtgttggagaagaaagagcagtatataaagaaataattcaagactgcagcactgtcaacctgaaactttgtaaatatttcctagcttctggtttggtgcggtgacagcactttcatcacaggatgttaccttgtattcaccaggcggagtgcgagctgctgcacatcctcctcagatctcacctgtccccactgtacatccacccgccagctgcttgcaaacctcatctctagctttagttcgaaaccacattgcagggttcaggtgacctctacaaaaaactacctcttcagaatgaggtaatgaatagttatttattttaaaatatgaaaagtcaggagctctagaacatgacgatgatttaagattttaacttttttgtgtacttgtatttgagcactctcattttgtcctaaagggcattatacatttaagcagtaatactgtaaaaaaatgtgttgctcgg

SEQ ID NO: 386476 - DNA, 453 bp, Homo sapiens
  misc_feature (1)..(1): n is a, c, g, or t
ngatccgtgctgatatcagtctttccaactcagtctgaggtaaacaaaccctgcactggttgatgcaacagttatggccttccctaggacagttgccaggaaagataatgttgattcttctcagaagccatcccgaacacctctgtttttttctaaaccgggctagaatgctgtggtgggctcctagaggtgaggtagagagtgtgacacatcaggtagtgtgccacacacacacacacacacacacacacaaacacacatacacaaataaactgttcaagttatctcatttatatgaacatcaatctggagaacaggcatggggatggatattaattgtatgagattatggtgtaaggaacatagagttgtatcaggctgaatttactgattaggaccatcaaggtagtgactttgtgtttaatatggcagcttggcgagttaaaaaaaaaa

SEQ ID NO: 386477 - DNA, 848 bp, Homo sapiens
ggtcctcttcagaaggtcagttagctcaaggcaatcacattcttcccaggcctcttaagaaatactccaaccccagaaaaggcccttctttctggtatcaggagccatgggccacaaacacaaatccaatagcatttcagccatttacctcccagatcatcccctccctgaagttctaactacagcaggaaaaaataatgaaaacaccacctgcagtcacaaatcctccagtttcctggccaagatgtcacattcccttcaagatacctcccaaagaggacatgacaagggaggggcacagagggtgctacaggtactgataaggttctatttcttttttatttttattttttgagatggagtttcactctagtcacccaggctgttgagtgcaatggtgcaatcttggctcactgcaacctctgcctcctaggttcaagtgattctcccacctcagcctcccaagtagctgggattacaggcacctgccaccacgcctggctaatttttgtatttttagtagagatggggtttcaccatcttggctgggctggtctcaaactcctgtcctcaggtgatccacctgccttggcctcccaagtgctgggattacaggcgtgagccaccatgcccagccaaaggttctatttctttaaagtttggtgttgtgcatatgttcatatgatttaatgtttttttttaaaaatggtatcttcctgttttttgtgtgtgtgtgttttttttgttgtaggcctgagtgcttcattcgttcacccatatgaatccgtaaagaagtagccattagcaacttcagcctatactggattcatactttaggaagacaaccc

SEQ ID NO: 386478 - DNA, 773 bp, Homo sapiens
gcagggacatggatgaagctgaaaaccatcattctcagcaaactaacacaggaacagaaaccaaacaccacatgttctcactcataagtagaagctgaacaatgagaacacatggacacaagctctccaaaaccatgagggagaagaagtcagagaataatgaagttcttccttacgtgatgtgcttcttattcccaagctatctttgtactctggacctggctgatgttgaaagcagagcattcacatgagcattttctgggttctttagaggctcccctgctggaatccctcaattgtaagtttccagaagttgctgctggttttcagcagttcactacatgcagaatctctccattgaactttaaaaaaatgacccccagactgaaaattgctttgaatagttgcattctgacaccttgtattggaacttcatatcagctgtgttatgtgtccatggtggaaaattccaattaaacattaaattatatataagaaagaaaatgaagttgatttctagttccaaatgacctacacagaaataacagttgtatataggtttgcacatactttacaaacatttttaggtatgtagaaacaatgtatacacacacatgcacacacacattagtgcaaatgctagtgtatgcatatccatatgtattgtatgtgtgtatatagatatacatatgtgcaaatatataatgtatatgcatatatgcagtggatgtatgtgcacatacatcttctatgtgtgtgtgtgtgtgtgtgtg

SEQ ID NO: 386479 - DNA, 531 bp, Homo sapiens
gcagggacatggatgaagctgaaaaccatcattctcagcaaactaacacaggaacagaaaccaaacaccacatgttctcactcataagtagaagctgaacaatgagaacacatggacacaagctctccaaaaccatgagggagaagaagtcagagaataatgaagttcttccttacgtgatgtgcttcttattcccaagctatctttgtactctggacctggctgatgttgaaagcagagcattcacatgagcattttctgggttctttagaggctcccctgctggaatccctcaattgtaagtttccagaagttgctgctggttttcagcagttcactacatgcagaatctctccattgaactttaaaaaaatgacccccagactgaaaattgctttgaatagttgcattctgacaccttgtattggaacttcatatcagctgtgttatgtgtccatggtggaaaattccaattaaacattaaattatatataagaaatataaaaaatcaaaatggccttgctggcctca

SEQ ID NO: 386480 - DNA, 276 bp, Homo sapiens
gtaatagtggcctcataaaatgagctaggaagtgttccatcctcttctatttctggggggagattgtgtaatactgatgttaattctttaaatgtttgggatgattcttcagtgaacaaagtgatataagcacggagatttcttttttagaagccttttagttatgaattcattttctttaatggttaaaggactattctgatgatttgggggttttttgttgttgttgttgctttttttttgagatggagtttcactcttgttgcccaggctgga

SEQ ID NO: 386481 - DNA, 520 bp, Homo sapiens
caacttccagcaatgatttacaggaagcgtttagctcatgcatatattggggccaatctgaaaaggaatcaaggttcatgaaactctcaactgtgacattttatagggtatggcgcaaccagagttagctaagtacagatatcattagctatatgttcatttgattgctattacatattctctctctctgacacacacatacacacacacacacacacgcacacacacacgactgaattatattcagcagtattttatgctctttggaaactgttacttattcagatacagggtgttttgtttttgctttttgctgattctctactaattttattattcccaatactctctttcattttgaattatggagtttattgcagtattgtattttttgagatgtaaaaactattataattagaactaaatttttcaaaaatggaaacatgcaggttaaatgataaaaatagtgtatttgtgaaatttgggttccgttttgttttgtcatcatagcaaatagaga

SEQ ID NO: 386482 - DNA, 410 bp, Homo sapiens
cataacaagtaaaatatatttaggactgccagtgtagcagaggccacagtgacaggtccttgctcatatccctcaggtcttctctgcaagcttccagctgtcagtacgtgcctctctgccctcaggccatttccccaagcccaaggagcctgctctacctgtgcacaaaacaggcctgaagtttagaattactatgcccaggaggagccattaccaatgaccaataagtgctggtgattgataccccagcttcctagtccttgagccaaggtaattctaaagtgtgtgttttatttcacggtggggctaagcttctaacgtacttttgagtggctgcattttctatccctgtgtcgtacacctgccataccagtgtttcctgcaactttcaaataaaccactagtcctcg

SEQ ID NO: 386483 - DNA, 420 bp, Homo sapiens
taaaaagtgcctatttcaatctctgagataaaaatcacaggtttatcttttcatgacaacttaatgaaatggcttgcatattattagtatgagaaatgtactttcaaatatataaaagtaattagagttcttagattttagaatatatatgaaagaatacatcatttttataattgtaaaggtaaacctaaacctgctgattagcatactacattttcctgttatttacaaaaccccgttttgctgacataggcatagagataagcagatatgcagtataatttgccaatatgtaataaggttaaattcaaatagaagaaagtatgctaattagtacagaaaacttagagaaagtactaatttagttaagattaattctgttcttattttaattcaaaagatagatcaatttctgtttat

SEQ ID NO: 386484 - DNA, 2628 bp, Homo sapiens
agcggggggcgacgtgccctgcgtccccctcggcgggctgccgccgtgcccgcgccggctccccagcccgagcctgccccttgccctggtgaggtgcaaagagcgggatcggaggcggggcctggccgggctgtgagcggcgtatgcaaatcgagggtctcggggatgcggatccaagaccctgggaaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaaaaaaaaa

SEQ ID NO: 386485 - DNA, 1367 bp, Homo sapiens
agcggggggcgacgtgccctgcgtccccctcggcgggctgccgccgtgcccgcgccggctccccagcccgagcctgccccttgccctggtgaggtgcaaagagcgggatcggaggcggggcctggccgggctgtgagcggcgtatgcaaatcgagggtctcggggatgcggatccaagaccctgggaaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagta

SEQ ID NO: 386486 - DNA, 2536 bp, Homo sapiens
agcggggggcgacgtgccctgcgtccccctcggcgggctgccgccgtgcccgcgccggctccccagcccgagcctgccccttgccctggtgaggtgcaaagagcgggatcggaggcggggcctggccgggctgtgagcggcgtatgcaaatcgagggtctcggggatgcggatccaagaccctgggaaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggacttcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaaaaaaaaa

SEQ ID NO: 386487 - DNA, 1079 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaaggtaagttgcacaaaggttttggacaatattccacaggcatttctcattgataacgaggaaagctacaatttttaaactacaaaatgatgaaagatcatggaatcacctctgttagaaatgtttgagaatattttgctgccagatgaattctcataggactgatataaggatttcaatagtcttctttatgttactcctctgctaataggtgaagtaggactttagctttgttcttaactccaaggggactttctgcctcttggaatttcactaggaattcacaagtgaagatgttacgtttctcacttcggaacactaaaaaactattttcaagatcattgaaatttatgctggattgacataatcctatacaaatctagtaataaagacaaatgtaaattgtgtccaaaaatgtatgtttatcctttccagatttctataatgatttctgggcagtgggtttttttttagcctatgtgttcatgacttcagaagtttagaaggtccctgaactccaaaattatgcacaaattttcatgaatattatcttaaagaggtctgtgaccccaaaatattagtaacatttactttaagcttttcagtaccactatactgacctcttaatgactggagcccaatcactgttgcctgccagtgccccacatctagatgtgtttccctgccttaccaattctttgtgttctttcctcaaatggatgctttccaatgtgattgagtaaattaataaactctggtaaagaaattaaaagttaaaaaactg

SEQ ID NO: 386488 - DNA, 603 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcaggtgtgcacatttggcattttaaaaaatgtgatggaatttactttctcattttggtggggtgtcactatatggacttaggggtcttcgatcacaaagcatttgagaa

SEQ ID NO: 386489 - DNA, 935 bp, Homo sapiens
gtaacacatcttcatgtatgtttttccagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgtaaaaaagacaaaaaaggagacaagagaacacacaagatgtagggacgaaaaaagcagcacagcagaacagcagagaacagacaagaaagaggagacagagggacacaaagaggcaaagcgaaaaagtggacaacagccggagatcaccaacgagaaaaccggcgcaaaagaagatagtaggcgaggtaatatccacacaaagaaaaaaaacagcgcgggcgaacataagagcagagcgtagtagaaagaaacgcggagagagagcacggaaggtacacgcggggaaacaaaaccggaaaacacgagaggcgcgtagataaaagaatgccggacgcgg

SEQ ID NO: 386490 - DNA, 717 bp, Homo sapiens
gcaatccatctgctgactcaacttgctagtatcgggcagcagccaggaccacagctcctccagctcctttgtgaccttttccttcagcttcttcaaatactgggttagacacctgcctggaatatagtgagtgttaggataaagtaaacatagaccagaggaagaagtcaaatacgcatttgcctcagaagaggcaatgaatccctttgtggagggaaaggttcaatatagttaagagcatgagatgggcttcacaatggaagatcaggcttccggtccattcctcgcctcttataacctgcacaactttagccaagtttcttagtcttataccttttctgtcaaatggcagcaatggtatctgccttatgaatttgttgtattaaatttgttgataatacctggagagagcttagcacattatctagatcataataagtactcaagggtattagctatttttattattctgctaatgtagtggtgatgtggtaaatagtaaaatattcaggaattttaaaaagctttaaaagtatcttaaaaaattagttcttaatggctttatatatgttcataattaggtgaattaacttttatatcctttgccaaaataatacttttggaatataggtattcaactatccagcattaatttacttacaagatgtttcaagcttcatttactattaaatcattatttaatacaacataaataac

SEQ ID NO: 386491 - DNA, 405 bp, Homo sapiens
ctcgtgccgaattcggcacgagcggcacgatgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggtatttagatgacatgagt

SEQ ID NO: 386492 - DNA, 230 bp, Homo sapiens
attcggccattatggccgggattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386493 - DNA, 405 bp, Homo sapiens
ggaaggtcaatgatagcatctgcctagagtcaaacctccgtgcttctcagacagtgccttttcaccatgagtgggtgcccatttttaggaaacaactttgggtgagtatttacctttattctaagtgggttttggcttttagaagtatcaggtgtgagcattttaatttctgaatttaaggagcattgaaaactgtcacctttattcctttgtctaacaatctactctaaagaaaatttgcaatgagaattttaatcacccatatcattagttaactgtgttttctaaagcactatttttccctcttgatttattaaatttgcagaagccagcaaaggaggtcttatctatgggaactacctgcatgtaagtggcagggtccttacagggtttggtgtccattgt

SEQ ID NO: 386494 - DNA, 2039 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgtaaaaaagacaaaaaaggagacaagagaacacacaagatgtagggacgaaaaaagcagcacagcagaacagcagagaacagacaagaaagaggagacagagggacacaaagaggcaaagcgaaaaagtggacaacagccggagatcaccaacgagaaaaccggcgcaaaagaagatagtaggcgaggtaatatccacacaaagaaaaaaaacagcgcgggcgaacataagagcagagcgtagtagaaagaaacgcggagagagagcacggaaggtacacgcggggaaacaaaaccggaaaacacgagaggcgcgtagataaaagaatgccggacgcgg

SEQ ID NO: 386495 - DNA, 1985 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaattgtttcatctttataaacttgtaaacttcatctatttcaaatattttatgcagtacattatattattctgtacaaaggctttcaaacaaaatttttaaaataataaagtattaatctttctccctgtaaaaaagacaaaaaaggagacaagagaacacacaagatgtagggacgaaaaaagcagcacagcagaacagcagagaacagacaagaaagaggagacagagggacacaaagaggcaaagcgaaaaagtggacaacagccggagatcaccaacgagaaaaccggcgcaaaagaagatagtaggcgaggtaatatccacacaaagaaaaaaaacagcgcgggcgaacataagagcagagcgtagtagaaagaaacgcggagagagagcacggaaggtacacgcggggaaacaaaaccggaaaacacgagaggcgcgtagataaaagaatgccggacgcgg

SEQ ID NO: 386496 - DNA, 1190 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagataaatggacaaatggatacatcgggaaactgaaaaacttctgtggtcccttgaaaa

SEQ ID NO: 386497 - DNA, 1663 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaatcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386498 - DNA, 1642 bp, Homo sapiens
aggatcccccgggctgcaggtttttaggacgctatcttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386499 - DNA, 1648 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattaatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386500 - DNA, 1703 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386501 - DNA, 1996 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgtaaaaaacaaacaagaagcagccacacacacacacaattgttggggcggccggggccatcgaaaaagctcctcaaaaaccatctgtggggcggcgcggccccataggtagcgacctgtgccaacggggtccccaagacatccgggcagacaggtgcgggatcacccaaaaaaaagccggcggcaccgaggctcgaaacaacccaggggtggaggcgaagcaccaacacgagccaggagcgataatgcccgagagagagcagacagcccacacaacacacccaccaacacggcagc

SEQ ID NO: 386502 - DNA, 1649 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386503 - DNA, 1649 bp, Homo sapiens
ggaaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgctcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386504 - DNA, 1790 bp, Homo sapiens
gcaatccatctgctgactcaacttgctagtatcgggcagcagccaggaccacagctcctccagctcctttgtgaccttttccttcagcttcttcaaatactgggttagacacctgcctggaatatagtgagtgttaggataaagtaaacatagaccagaggaagaagtcaaatacgcatttgcctcagatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386505 - DNA, 1649 bp, Homo sapiens
aggtttgctgtttattttctattttcacattctatattgtggtttagcctgagagaggctaacgttttctttgatcatatcactcaatgtggccattaatatttctggagaagacacaaacctatttatcatacttcataaagatccgaagtgatcctacgaaggaggttacattgaaggtaacacttaagagttgacataacattctgaatgcactcaacatgataaagattcgttaatacaacttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgta

SEQ ID NO: 386506 - DNA, 338 bp, Homo sapiens
gagccggacccagttcgctctgaaacagttcttctttattaagctgcatgaggtactttgtattgtattagtattcacgtttcacagataaaaataccacatcttcacataaatggcttggttaaagctcacagccagtaaataagagagctggttaggaatctagttctgatttcagagtcactgttttgtctgtctgtttgtttgtttgtttctttgtttgagacaaagtctcgctctgttgcccaagctggagtgcagtggtgggctcactgcagccttgacctcccagactcaagtcattctcccacttcagcctcccaagtagctgggactac

SEQ ID NO: 386507 - DNA, 1143 bp, Homo sapiens
ggaaagggtaagtggtgggaataatgcaaaatgatagtttaaaaatccttcatgccctgtttactttcctaatatggagataattgaaatctggactgggaataatttttttttaaaaaaactggattttccttgggcattgccatttactaatctcatgatcctgggcgagtcatgtaatctctttaaaacttattaactcataaaaatagaagtaacaatgtccaaacttcctattttagagttttcacgaggcgcaatagatgtaactgaaagcttcgagaagtttaaaggacttgcaaggaaatctactgaaataagccccattccacctgggcagaagcactcagacgccaaaccccaccttctgtcctgaaattcaccttccactaggagagtttgcttttctaatgcttcaaatgcacaacgggagatgttctgacttcagggtttctacccttcactgctgtaatctgctgcctgtatgacatgcgatctggtttacaccgtacagcttatcatcttcagcttgtggccccttccttgtttccaccttgctattcaggagggcctgtaagggtatctggattccttgagctgtagatgcaggacagtgagagggagggaggtagttctctggtctaatttcagtttcctaactgagggtacatgccttccctgaatgatcatcatcaaaaatatccagcccttcatggaagacaccacccctcctcatagatgagtccctgagcttatgatctcaaaaggaaatccttatcagaatacaacagaataaggacatagtttcattacagttataataataaaagtagttcttctttattaagctgcatgaggtactttgtattgtattagtattcacgtttcacagataaaaataccacatcttcacataaatggcttggttaaagctcacagccagtaaataagagagctggttaggaatctagttctgatttcagagtcactgttttgtctgtctgtttgtttgtttgtttctttgtttgagacaaagtctcgctctgttgcccaagctggagtgcagtggtgggctcactgcagccttgacctcccagactcaagtcattctcccacttcagcctcccaagtagctgggactac

SEQ ID NO: 386508 - DNA, 1234 bp, Homo sapiens
tatgagcaggcgctaaacctggtttaggtatttaggcagcgcgcggcccggctcgtaactcctcctgctgcagcaggcgtatcgttggcctcgcctcgaccccggaagtgacttctggaagtgacccaggaagtgacattttagctttaggtttaattggttcgactgccttctccacaatttgggcgagaatttcctttgccttctcagcaaaagttgttctgcggacccgtctgggtcaactttcatgagggacattgagacaaacaaatgaaatatgggttaaagtactctgagcagctacaaaaagaagaccagtctatcctgctggagacagtggccacgtgaagaaagagctcttgcagtatgaaagaccacatggaaagagaggccacatggaaccaacagtcagcatcttggtttcggacacgtgaagaaattcatctcagactgtgtatcctaaatcaggcacttgctgaatctaactacatgagtgagaccagttgacaacacatggagcagacatgagctgttctcagtgagtcctacacaaattcctgactcacaacactgtgagcaataaaatggttgttattttaagccactgaagtttgcagtgatttcttacataggaatagataaatgaaacacaaacattgatcatttgcatcttctatcttttttatgactagtcttattggaaattaccagtttatttctgccatggttagaaaacaaactctgaaattttgatactttaaaatttttttgagacttactgtgcccagaatatagtctatcttggtgaatgttctgtgagcactagacaagaatatgtattctgtagttattgagcattgtgtccatcaatgtcaacgtgattaaggtggttaatagttgtcttcagatcttctatattgtattgattgttttatgtgtagtgttgctattaattattgatacaggagtgtaaaacttaaactatggctgtgaatttgccacttactttagttttgtcagcttttcttttgcatttttgaagctctgttattgggcatataaacatttatggttcgtgtgtcttcctgatgaattgaccattttatcattatgaaatgtctttattgctgataatactccttatcttgaagtctaattcatccgatattagtatagccactgcagccttcctagcttactgtttactggtatatttttatccatgtttttactt

SEQ ID NO: 386509 - DNA, 356 bp, Homo sapiens
caacctgtgttttttaatttaatgtgcttctcttatagacaacagatagttgagtttgtctatcattttgctatttgttttcgatttgtcccattcagttttgtgttcctttgttctttacttcctgctttcttttgggttaattaatgtttttgtatttcatcttaattcctctgttggctttaactgtatctttttgcattattgctttacagtgtttctgagaattatgatatacattcttaacttatcacagccttagagttaaaattatgatacttcatgtaaaatctttgttgtcatatatatcatatctatgcacattgttatttttgccttagtcatatgtatcgcaa

SEQ ID NO: 386510 - DNA, 1432 bp, Homo sapiens
aagcagtggtatcaacgcagagtgcccattacggccggggagtgagctgcctctctgcgattggttttgcccgagttttatttttgtctgtctcagctagaaagtgggagactttcatttaaaatggaaattggggcgaggggttggcggctgggcgaagggagcattcaaaagcggagaatgtcactttacccgagaaattcactacgatgggccattggtttctgctcggctcgcaggcgcactgcacgagtggaggtgtggctagtggctgtgatgagataaatccatgcatagccttttcattgcgagcttgaaagttcttttctattacagttttagctttaggtttaattggttcgactgccttctccacaatttgggcgagaatttcctttgccttctcagcaaaagttgttctgcggacccgtctgggtcaactttcatgagggacattgagacaaacaaatgaaatatgggttaaagtactctgagcagctacaaaaagaagaccagtctatcctgctggagacagtggccacgtgaagaaagagctcttgcagtatgaaagaccacatggaaagagaggccacatggaaccaacagtcagcatcttggtttcggacacgtgaagaaattcatctcagactgtgtatcctaaatcaggcacttgctgaatctaactacatgagtgagaccagttgacaacacatggagcagacatgagctgttctcagtgagtcctacacaaattcctgactcacaacactgtgagcaataaaatggttgttattttaagccactgaagtttgcagtgatttcttacataggaatagataaatgaaacacaaacattgatcatttgcatcttctatcttttttatgactagtcttattggaaattaccagtttatttctgccatggttagaaaacaaactctgaaattttgatactttaaaatttttttgagacttactgtgcccagaatatagtctatcttggtgaatgttctgtgagcactagacaagaatatgtattctgtagttattgagcattgtgtccatcaatgtcaacgtgattaaggtggttaatagttgtcttcagatcttctatattgtattgattgttttatgtgtagtgttgctattaattattgatacaggagtgtaaaacttaaactatggctgtgaatttgccacttactttagttttgtcagcttttcttttgcatttttgaagctctgttattgggcatataaacatttatggttcgtgtgtcttcctgatgaattgaccattttatcattatgaaatgtctttattgctgataatactccttatcttgaagtctaattcatccgatattagtatagccactgcagccttcctagcttactgtttactggtatatttttatccatgtttttactt

SEQ ID NO: 386511 - DNA, 1084 bp, Homo sapiens
tatgagcaggcgctaaacctggtttaggtatttaggcagcgcgcggcccggctcgtaactcctcctgctgcagcaggcgtatcgttggcctcgcctcgaccccggaagtgacttctggaagtgacccaggaagtgacatactctgagcagctacaaaaagaagaccagtctatcctgctggagacagtggccacgtgaagaaagagctcttgcagtatgaaagaccacatggaaagagaggccacatggaaccaacagtcagcatcttggtttcggacacgtgaagaaattcatctcagactgtgtatcctaaatcaggcacttgctgaatctaactacatgagtgagaccagttgacaacacatggagcagacatgagctgttctcagtgagtcctacacaaattcctgactcacaacactgtgagcaataaaatggttgttattttaagccactgaagtttgcagtgatttcttacataggaatagataaatgaaacacaaacattgatcatttgcatcttctatcttttttatgactagtcttattggaaattaccagtttatttctgccatggttagaaaacaaactctgaaattttgatactttaaaatttttttgagacttactgtgcccagaatatagtctatcttggtgaatgttctgtgagcactagacaagaatatgtattctgtagttattgagcattgtgtccatcaatgtcaacgtgattaaggtggttaatagttgtcttcagatcttctatattgtattgattgttttatgtgtagtgttgctattaattattgatacaggagtgtaaaacttaaactatggctgtgaatttgccacttactttagttttgtcagcttttcttttgcatttttgaagctctgttattgggcatataaacatttatggttcgtgtgtcttcctgatgaattgaccattttatcattatgaaatgtctttattgctgataatactccttatcttgaagtctaattcatccgatattagtatagccactgcagccttcctagcttactgtttactggtatatttttatccatgtttttactt

SEQ ID NO: 386512 - DNA, 198 bp, Homo sapiens
tcagctagaaagtgggagactttcatttaaaatggaaattggggcgaggggttggcggctgggcgaagggagcattcaaaagcggagaatgtcactttacccgagaaattcactacgatgggccattggtttctgctcggctcgcaggcgcactgcacgagtggaggtgtggctagtggctgtgatgagataaatcca

SEQ ID NO: 386513 - DNA, 541 bp, Homo sapiens
tttgcatttttgaagctctgttattgggcatataaacatttatggttcgtgtgtcttcctgatgaattgaccattttatcattatgaaatgtctttattgctgataatactccttatcttgaagtctaattcatccgatattagtatagccactgcagccttcctagcttactgtttactggtatatttttatccatgtttttactttcaacctgtgttttttaatttaatgtgcttctcttatagacaacagatagttgagtttgtctatcattttgctatttgttttcgatttgtcccattcagttttgtgttcctttgttctttacttcctgctttcttttgggttaattaatgtttttgtatttcatcttaattcctctgttggctttaactgtatctttttgcattattgctttacagtgtttctgagaattatgatatacattcttaacttatcacagccttagagttaaaattatgatacttcatgtaaaataaaagagccttgcaatagtaaagttctacttaccacctcccc

SEQ ID NO: 386514 - DNA, 237 bp, Homo sapiens
ttatggatttgagttaccatctggtatcactccctttcagcttgaagaatttcctttagtattttaaagcaggtccactcacaataaattctgtctttttaatgtggaactctttgtcttcatttttgaagaacagttttgctagatacagaacatttaacaatttttttttttttgagatagtctcgccctgtcgccaggctggagtgcagtggcgcaatcttggctcattgcaac

SEQ ID NO: 386515 - DNA, 416 bp, Homo sapiens
aatttttttttccttcctgctgcaagcttgttaacagccatatcttcagagatgggccaacatgtgataatgaagaaaagggattatacagcactttgtgaaagcccttcctagatgcagaaaagtataaagagaaacagcacagtgactggtactttcttttttttttgagacagagttttgctctgtcacccaggctggagtgcagtggcacgatcttggcttactgcaacctctgtctcccggtttcaagcgattctcgtgcctcagcctcccaagtagctgatattacaggcacacgccaccttgcccagctaatttttgtatttttagtagaggcagagtttcaccatgttggccaggagttcgagacccagtgtggggagcgtagccagaccctaactctgttatttgga

SEQ ID NO: 386516 - DNA, 1298 bp, Homo sapiens
taagaggctggggaggcaggcatagcaaccagagctggagactgatgtgaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctaggtaatggaatacaagattgggaagccccattcccctcttcccatttccaccctccatgttatgacgatagaaatgtgaaaatgcttccttggggtgctttcaatacatgtgcagtggaaacat

SEQ ID NO: 386517 - DNA, 1348 bp, Homo sapiens
tgagcctttcttctttcccttttcccagaaaaggctcaacatcaactatatagccaacatgtccaaggtgtttaagaagaccagctccaatgggaaggtgagagaacctggcccagctgggcaaatgagagggcaaaagggatagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctagctctgaggacatagtcatcgaggagtttacgcggaaaggcgaggaggagagccagaaggctgtggaggctgagggagatgaggggagctgagcacctcgctctggtgcccgtctgtgtgggagcccccactgtaacactctaataaatcagtttgttcagatgtga

SEQ ID NO: 386518 - DNA, 1341 bp, Homo sapiens
taagaggctggggaggcaggcatagcaaccagagctggagactgatgtgaacttcatctctctccccagaaaaggctcaacatcaactatatagccaacatgtccaaggtgtttaagaagaccagctccaatgggaagctctccatctacctggggaaacgggacttcgtggaccatgtggacacggtggaacccattgacggtgttgtcctggttgatcctgagtacttaaaatgtcgaaagttgtttgtcatgttgacatgtgcctttcgctatggccgtgatgacttggaagtgattggtctgacgttccgaaaagatctgtatgtgcagaccctgcaagtggtcccagctgaatccagcagccctcaggggcccctcacagtcctacaggagcgactactgcacaagctaggggacaatgcctacccctttaccctgcagatggtgaccaacctgccctgttctgtgacactgcagccaggtcctgaagatgcaggaaagccctgtgggattgactttgaagtgaagagtttctgtgctgaaaacccagaggagacagtctccaagagagactatgtgcggctggttgtccggaaagtacaatttgcaccaccggaggcaggccctggcccctcagcccagaccatccgccgcttccttctgtcagctcagcccctacaactccaggcctggatggacagggaggttcactaccacggagaacccatctctgtcaatgtttctatcaacaactgcaccaacaaggtcatcaaaaaaatcaagatttcagttgaccagatcacagatgttgtcctgtattcactagacaagtacaccaagactgtgttcattcaggaattcacggagactgtagctgctaattccagcttctcccagagctttgcagtaaccccaatcctggctgccagctgccagaaacggggcctggcactggatggcaaacttaagcatgaagataccaacctggcctctagcacaattattagaccgggaatggacaaagagctgctggggatcctggtgtcctacaaagtcagagtcaacctgatggtgtcctgtggtggcatcctaggagacctgacagccagcgatgttggtgtggagctacccttggtcctgatccatccgaagccatctcatgaggccgctagctctgaggacatagtcatcgaggagtttacgcggaaaggcgaggaggagagccagaaggctgtggaggctgagggagatgaggggagctgagcacctcgctctggtgcccgtctgtgtgggagcccccactgtaacactctaataaatcagtttgttcagatgtga

SEQ ID NO: 386519 - DNA, 758 bp, Homo sapiens
ctgcctgggcgatagagtgaggctctgtctcaaaaataaaaaataaaaataataattttatagttaagttgccctgtgtttttcctgtgattaaaaaaaaaaatacctgtttggtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacac

SEQ ID NO: 386520 - DNA, 212 bp, Homo sapiens
attcatcttccatccattctttcattcatccatccacctgccatctttctgtcagtccatccacccatcatgcatccattcaacaggaggtgaggctgcttagtccatgccctgcttaagtgctccctggctccccagctggcccaggatgagcccctgcccgtcatcacagcccaggtcctgtggcctctgcttcctgcctgcattctcac

SEQ ID NO: 386521 - DNA, 986 bp, Homo sapiens
cttacacgcgtcctggcgtgtggctctcctgcgtcctcgtttttctcgtgagccctggatctggacagtgggcccggcgcgaggccctcaactccggctgggctcccggtggcactttctgccgaccctgagatgtacccgccacgcctgcgggactgacctctagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgttcaataaaggagacaagtgctta

SEQ ID NO: 386522 - DNA, 477 bp, Homo sapiens
gcctgtgcagcaccgcgaggtgcagggcaatgagtctgacctcttcatgagctacttcccacggggcctcaagtaccaggaaggtggtgtggagtcagcatttcacaagacctccactgtggcgcaagagaaccagggcgtcttcttctcgggggactcctacctagtgctgcacaatggcccagaagaggtttcccatctgcacctgtggatagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386523 - DNA, 1562 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386524 - DNA, 1268 bp, Homo sapiens
ggtggcacatttgattattttgcaaactctggaagaccttggctgagggtctaggtggactgtctgagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386525 - DNA, 2161 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcagaaaaaaaaaaaaaagaaaaaaaaaatgggggggtttttttgtcgggcgggcgggcgcaaaggggttcaacggaagggcgcctgggggccataagcttgttctcgggcacccgagttcttcttgggccaaggggggaagacttgcgcggggacccccatatggggagacggatataagttcagaaaagccagtgtaacccgggtattgacctcgcggacaaaagtcagacacgcgagacggttggtcgaatgcaggacggacccacttgtcagcaacagcgggcccagaggacaagttgtggaacccccgaccagagcgtacacacggccggcccagaaagagaggggaattaatacggacgagaggagaaggagtaaacgtcgccgatatgacgtaaagaaggcgagagacgggcaccaggcaggcgagggaggacagtgcaggagggcaaagaggagtacaacgccgaagaccgacgagcagggaggatcacgcagaagagccgaagaggaaacgaagcaaggcgcggaagagacacaggcgccagaggccacacaaggcccacgagaaggacacaggcgggagaaaaaggaataca

SEQ ID NO: 386526 - DNA, 1601 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcatttcagcggtgtgtttggtcccttgttgttggtgtgtat

SEQ ID NO: 386527 - DNA, 1329 bp, Homo sapiens
acacaaactctgtccaaatggatgcacagcatgaattgtattatgtacgaagtgcatgctggctctgtgatctctgcattttgagccaaaaaaagaaatcctctagtgatgggaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386528 - DNA, 1593 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggtttttcagaaaaggcttgatgaattcaagagggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386529 - DNA, 1458 bp, Homo sapiens
  misc_feature (1273)..(1274): n is a, c, g, or t
  misc_feature (1291)..(1291): n is a, c, g, or t
  misc_feature (1293)..(1293): n is a, c, g, or t
  misc_feature (1300)..(1300): n is a, c, g, or t
  misc_feature (1307)..(1308): n is a, c, g, or t
  misc_feature (1316)..(1316): n is a, c, g, or t
  misc_feature (1319)..(1319): n is a, c, g, or t
  misc_feature (1325)..(1325): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggaaanngaatgaaagagggaggncncctgagntggcganngttaatcnggntgagangccgaactcaggtggaggggcgacagggcctttaggttctgggcctgaccaaaggagaggcggactctgtggaaacagccttaccacggggcctctcagaattataagaggggccgggagagaacacggacgc

SEQ ID NO: 386530 - DNA, 1393 bp, Homo sapiens
gactcaccgggggcggctcctggccgcgcacctccagggggcggggggcggctgagacagcgcccagggcctcggagcaaggcgttggcaggagaggctttagcctagacagctgagtgtgaggaacagtgattcccattgatccttgttccctccgtgggtcacagagtccagaacttaagagccacccaagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386531 - DNA, 1653 bp, Homo sapiens
  misc_feature (245)..(245): n is a, c, g, or t
  misc_feature (410)..(410): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctttcccaacaacccgtgnccttgggcggggaaaagggcacgccccccaatgtggggggtttggggggtgcttttgggtcggggtggcgagagctttgggtacgggttagggcggcaatgccacgacgaaaccgtacaccgaacggggacacgggttgaacgcgaaaaacgggccccggggggntggggaggcaaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386532 - DNA, 1727 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagaggtaagctgcatgccccatctcctttcacaacttccccttctttacctccaagggctgcccctccccactgctctcctcatccccagactgcagtcgccaggcctgcccagggctgtgcttgggcaagtgggtccaggctgctgtcaaccctctctcttctcgcagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386533 - DNA, 1829 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagaggtaagctgcatgccccatctcctttcacaacttccccttctttacctccaagggctgcccctccccactgctctcctcatccccagactgcagtcgccaggcctgcccagggctgtgcttgggcaagtgggtccaggctgctgtcaaccctctctcttctcgcagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggatagggtaaggggatctggatgggggaaggttgggcccaggaaggggagggagggggctggtatggatcacaagggccttgccctgccctctcccacttgtcccaggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386534 - DNA, 1182 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgttcaataaaggagacaagtgctta

SEQ ID NO: 386535 - DNA, 1474 bp, Homo sapiens
  misc_feature (245)..(245): n is a, c, g, or t
  misc_feature (410)..(410): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctttcccaacaacccgtgnccttgggcggggaaaagggcacgccccccaatgtggggggtttggggggtgcttttgggtcggggtggcgagagctttgggtacgggttagggcggcaatgccacgacgaaaccgtacaccgaacggggacacgggttgaacgcgaaaaacgggccccggggggntggggaggcaaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386536 - DNA, 1042 bp, Homo sapiens
cgagtgggtccctgctttggctctccttgcaaagttatttctagttaattcattatgcagaaggtataaggggttagtccttgctatattatgcttggttataatttttcatctttcccttgcggtactatatctattgcgtcaggtttcaatttctatcgcctatactttatttgggtaaatggtttggctaaggttgtctggtagaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386537 - DNA, 1220 bp, Homo sapiens
ggtggcacatttgattattttgcaaactctggaagaccttggctgagggtctaggtggactgtctgagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386538 - DNA, 852 bp, Homo sapiens
  misc_feature (245)..(245): n is a, c, g, or t
  misc_feature (410)..(410): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctttcccaacaacccgtgnccttgggcggggaaaagggcacgccccccaatgtggggggtttggggggtgcttttgggtcggggtggcgagagctttgggtacgggttagggcggcaatgccacgacgaaaccgtacaccgaacggggacacgggttgaacgcgaaaaacgggccccggggggntggggaggcaaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggatagtcaacacgctgctgggagagcggcctgtgcagcaccgcgaggtgcagggcaatgagtctgacctcttcatgagctacttcccacggggcctcaagtaccagttgcttctctggctgcctggtcagtgcagaggtgccccctgcagatgttcaataaaggagacaagtgctttcccagctcttttcctgca

SEQ ID NO: 386539 - DNA, 1215 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcaccttgcttctctggctgcctggtcagtgcagaggtgccccctgcagatgttcaataaaggagacaagtgctttcccagctcttttcctgcagctcttttcctgcaccacctgccctgggctgattctcactgtcacccacctattcacctgggttcatccccatgctgggggtggagtagcacacagatgacaattggacagccttggaggggccagagctgctttgcatgacagaggagtcccagccaggcttgcagggactgccatgaacccaatagggaggtggcacagtgccaggcctcaggatcagttgcatccgggtgttcagttcagtctcacattcccaacagggagaaggttgtggcaatgggcttgggatgcagttccatttaaggcagtatttcttcggatgccctaataaagcactgccaggcagcttcaagtgacatatgcccactgagcaagagaggacagcctttcacaattgtaccaagcctggcttattacttcgtaggcacattgcccagcatgtttggctggtgagcccagggccactgcagggctgtgcgaaaagcaccaggctagcatgga

SEQ ID NO: 386540 - DNA, 613 bp, Homo sapiens
gggcaggtggctgccagcgcggctggctgctcccctcttcaactttagcactttctaatgctgacatctgtgattctgtgacattccccacttagaggaagttcgtctgcggtttcactgggtatggtggctcccttgttcactgcaccctgcagctaaaccataaaacatgggctattctttgtctctgtgcatgtcacccccagtgccaagcccccagcacagacgttgagtggaatggaatagactctttgctgggctgcttgaggaacagaggcatcaggtgtgtccttgctccagttgagatgtgaagcagccagtttatgctataaaacaggctaaagtatgtgctcccaggggagagggctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgagaggctgaggcaggagaattgcttcaactcaggaggcagaggttgcaatgagctgagactgtgccactgcgctccagcctgggcagcagagtgaaactctgtctcaa

SEQ ID NO: 386541 - DNA, 1124 bp, Homo sapiens
  misc_feature (939)..(940): n is a, c, g, or t
  misc_feature (957)..(957): n is a, c, g, or t
  misc_feature (959)..(959): n is a, c, g, or t
  misc_feature (966)..(966): n is a, c, g, or t
  misc_feature (973)..(974): n is a, c, g, or t
  misc_feature (982)..(982): n is a, c, g, or t
  misc_feature (985)..(985): n is a, c, g, or t
  misc_feature (991)..(991): n is a, c, g, or t
gaagaaaggaaagtaggagtgttgaaagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggaaanngaatgaaagagggaggncncctgagntggcganngttaatcnggntgagangccgaactcaggtggaggggcgacagggcctttaggttctgggcctgaccaaaggagaggcggactctgtggaaacagccttaccacggggcctctcagaattataagaggggccgggagagaacacggacgc

SEQ ID NO: 386542 - DNA, 923 bp, Homo sapiens
gctggtaccggtcccgagtcgtatggatcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactgggcgattactggccaggggggggtccagccattgcttgaagggggattccgcgaggggggggcacgggcggggggaccttttgggggggagtttagaggggg

SEQ ID NO: 386543 - DNA, 804 bp, Homo sapiens
tctagtagaggctggtgttatatccgacgagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggtctccgagctacgccagcgtagacggctgtgtgctggcacgttcacgcattgtcaccagacgacccttccatgcaggccagccccagactgctgcattctggatgaactctagccaggcgtgacacgcgggaccgaccgacacagtccgctgccacccgactgcgggcacctgaacctgggagcacgcgtttcaacactgtgcggactgcattcatccatggaccttgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctggcccccaagcctgctcttgaggaggcaccttagagacctcccgttgcacgcc

SEQ ID NO: 386544 - DNA, 2137 bp, Homo sapiens
  misc_feature (1595)..(1595): n is a, c, g, or t
  misc_feature (1603)..(1603): n is a, c, g, or t
  misc_feature (1608)..(1608): n is a, c, g, or t
  misc_feature (1618)..(1619): n is a, c, g, or t
  misc_feature (1640)..(1640): n is a, c, g, or t
  misc_feature (1651)..(1651): n is a, c, g, or t
  misc_feature (1653)..(1653): n is a, c, g, or t
  misc_feature (1664)..(1664): n is a, c, g, or t
  misc_feature (1666)..(1666): n is a, c, g, or t
  misc_feature (1671)..(1671): n is a, c, g, or t
  misc_feature (1683)..(1684): n is a, c, g, or t
  misc_feature (1687)..(1687): n is a, c, g, or t
  misc_feature (1690)..(1691): n is a, c, g, or t
  misc_feature (1694)..(1696): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcaaaaaaaaaaaaaaacaaaaaaaaaaaaaacatngtgtgggnggccntggggccccnnaaaaagtttttaaaaccattngttgtgggggngngggccccaatngngttangggaacgtgggnnaanagnngtnnnccagagagaacccgggccaaaaaaaagtgggggtgggattccccccaaataaaaaaaagccgccggggggggaaacacagagcgtgtccgggagcaaaatccccacgaggaggtcccgaggggggcaactacgggggaatcaacaccaacagggggggttacagcgagagcccgaataataaattagccccggcagcggagagaagaaataaccgaacaacaacaaagaacagcaacagagcaatagccacagacaagtcgcgacagcagacgagacatgacacaacgagacagccagagacaacaccgaagcagaaacgcacgcaaaccacaccaaacagacagtacaagacacgcaaccagccacacagacacaacagataggacaagaacacagacagatacgagacagaagaaggcgacagacgaaaagcaggaaac

SEQ ID NO: 386545 - DNA, 2063 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgcagctcttttcctgcaccacctgccctgggctgattctcactgtcacccacctattcacctgggttcatccccatgctgggggtggagtagcacacagatgacaattggacagccttggaggggccagagctgctttgcatgacagaggagtcccagccaggcttgcagggactgccatgaacccaatagggaggtggcacagtgccaggcctcaggatcagttgcatccgggtgttcagttcagtctcacattcccaacagggagaaggttgtggcaatgggcttgggatgcagttccatttaaggcagtatttcttcggatgccctaataaagcactgccaggcagcttcaagtgacatatgcccactgagcaagagaggacagcctttcacaattgtaccaagcctggcttattacttcgtaggcacattgcccagcatgtttggctggtgagcccagggccactgcagggctgtgcgaaaagcaccaggctagcatgga

SEQ ID NO: 386546 - DNA, 1291 bp, Homo sapiens
gactcaccgggggcggctcctggccgcgcacctccagggggcggggggcggctgagacagcgcccagggcctcggagcaaggcgttggcagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386547 - DNA, 1321 bp, Homo sapiens
gggcaggtggctgccagcgcggctggctgctcccctcttcaactttagcactttctaatgctgacatctgtgattctgtgacattccccacttagaggaagttcgtctgcggtttcactggatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386548 - DNA, 1228 bp, Homo sapiens
gaagaaaggaaagtaggagtgttgaaagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386549 - DNA, 1366 bp, Homo sapiens
cttacacgcgtcctggcgtgtggctctcctgcgtcctcgtttttctcgtgagccctggatctggacagtgggcccggcgcgaggccctcaactccggctgggctcccggtggcactttctgccgaccctgagatgtacccgccacgcctgcgggactgacctctagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386550 - DNA, 1451 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagtgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386551 - DNA, 1252 bp, Homo sapiens
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactgggcgattactggccaggggggggtccagccattgcttgaagggggattccgcgaggggggggcacgggcggggggaccttttgggggggagtttagaggggg

SEQ ID NO: 386552 - DNA, 1701 bp, Homo sapiens
  misc_feature (245)..(245): n is a, c, g, or t
  misc_feature (410)..(410): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctttcccaacaacccgtgnccttgggcggggaaaagggcacgccccccaatgtggggggtttggggggtgcttttgggtcggggtggcgagagctttgggtacgggttagggcggcaatgccacgacgaaaccgtacaccgaacggggacacgggttgaacgcgaaaaacgggccccggggggntggggaggcaaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggatagggtaaggggatctggatgggggaaggttgggcccaggaaggggagggagggggctggtatggatcacaagggccttgccctgccctctcccacttgtcccaggccagcagtcatcccgggatgagcagggggcctgtgccgtgctggctgtgcaccagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386553 - DNA, 843 bp, Homo sapiens
aggacaactttctccagccaaaacgtaacccgttcactagccaagcggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386554 - DNA, 571 bp, Homo sapiens
agaggatctttggatcgctgtattgggggagcagctgcttagatatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccatttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttcccagctcttttcctgca

SEQ ID NO: 386555 - DNA, 805 bp, Homo sapiens
  misc_feature (245)..(245): n is a, c, g, or t
  misc_feature (410)..(410): n is a, c, g, or t
tttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggctcccagcactgcctgcccctccctgtcgggggacatcgcctttcccaacaacccgtgnccttgggcggggaaaagggcacgccccccaatgtggggggtttggggggtgcttttgggtcggggtggcgagagctttgggtacgggttagggcggcaatgccacgacgaaaccgtacaccgaacggggacacgggttgaacgcgaaaaacgggccccggggggntggggaggcaaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcaccttgcttctctggctgcctggtcagtgcagaggtgccccctgcagatgttcaataaaggagacaagtgctttcccagctcttttcctgca

SEQ ID NO: 386556 - DNA, 2332 bp, Homo sapiens
  misc_feature (8)..(8): n is a, c, g, or t
  misc_feature (10)..(11): n is a, c, g, or t
  misc_feature (2331)..(2332): n is a, c, g, or t
aagcttanannaaaatattatggtttaagctgatttattttaaccgtagcactactgctttattttagttatatatcaataatggaaaatagtggccacttttcattattaatcataagataattcattgtatttgtctttcctaataaaatggcattatattaaggcccaaaatgtttactatggcccagtaaaatatagggttgttctgtgagctatttcttaggatagaaaattattccagaaagctattagttcaaaagtctctagcagtgccaaggtttcaatagtctctttaattttgaatctatgcgattgaagataagactgcatctagtttgggggttgcatgtttgtggacattcatgtttctatgtacctggaacttcttattctcaccatcacacagaattttcaagaactagttaagcaaagaaagcaaagcccagcaggtgtcagaattgggtccccaagctgagggtcattagggtgcatgtcagtgtgccaactccaatatccacacctagagaacgcacatcttcccaaaagaaatgaagcacagatgatacttgatcctcaactttgtctccagaaattttttcaggaacttgagttctttatcaaatgctcacatcctacagagaaataaagtgttccattttcaaggttcatgaagctcgtcaatgctgggagcaggcacacacttgtatttttatactcagggatcccaacaggcaactaaaactagacaaggacaaaactccactcaaaatattctgaaagttagctgatgccccatattttattactccaaatgtgtattcacttgcctgagtgctggccatgagcactcagtgaacacttgcagtacagtgagtgatgtccttgacaagttactatgaagactctgagaaaaagtaacatcccccactgtcctcaacaagcctgtaatcccatggctgccagcccttaccatgcaacaacactgcgctaagtgcatcgaaccacacaaaaccctgtgagaaaatactgcttcccacttcacacgtgaagtaactgagtctagttttagaaatacctaaacgaagagggacaggcacaacaaatttgctggaatgtaaagaaagtagatcagtttctgcgtaagcagtaagaaatggcctcatgaggaagaaagggacatttgccctgacatttctcaaagactgcttaggttttggagacagagatccaagggcaggcaagcacaatggttcatgcctgtaattccagcactttgagaggccaaggtgggaggattgcttgagcccaggaattcaagattagcctgtgcaacacagcaagaccccatctctattttaaaaagagagagagagatccaaaagcaaaggcatttcagtttgcaaggccagcatgggagagggtcttaaaacagaaacacacaaggtaagattgggggatggtacctagaccagcctaggatcataggatttgataaaatatgcatttggaaaactggtgctaatttatagagacttagaatttcaggctaaggacaaggactaagaaacgaatagcatgaacagtattattgataaacccatcattgcatcttaaaggctctgaagtctttagtattgaattaaaaaataattttcactggacaaaaccaaaaggtctttacacaactgtcaagcactttgaaatgattcagcaaaaagcagaataaatcactagtggaatttcaatagcatgtagttgtaaaccatcatgtgtccagcaaaatcacaaaacaagagtttattttagaagggacttagggatattaagaaatataacatacaaaataactaaagttttctccaagcaaaaccaatgatcctttagggatgaacagaaagaaaacaagaaatgcttctttcaaaagttgctaccaaggcttctaagatttctttggaataaagtcactaagatttgcttctgaggtcaatcttgccaacttttccaccatgctttttaggaaggaacaccaggtagggctcaagtactggtttggctcctgtcccattttttggtccttttgtaactccctttactcaactccaagtatgtctgtgcacggacaatgagacgaaagcatgctcaatgcgaaagcacaaattatgtattgagaaatcactacaatgccaaatttttttaaaataaaaaaaaatatatatatatatatatatatatatctttaagaactcgctgtgttagggaaactgtttacatattgaggtgttcctctttttttgactggaacaataaaagaaaaatttgataaaaaann

SEQ ID NO: 386557 - DNA, 2278 bp, Homo sapiens
  misc_feature (8)..(8): n is a, c, g, or t
  misc_feature (10)..(11): n is a, c, g, or t
  misc_feature (2277)..(2278): n is a, c, g, or t
aagcttanannaaaatattatggtttaagctgatttattttaaccgtagcactactgctttattttagttatatatcaataatggaaaatagtggccacttttcattattaatcataagataattcattgtatttgtctttcctaataaaatggcattatattaaggcccaaaatgtttactatggcccagtaaaatatagggttgttctgtgagctatttcttaggatagaaaattattccagaaagctattagttcaaaagtctctagcagtgccaaggtttcaatagtctctttaattttgaatctatgcgattgaagataagactgcatctagtttgggggttgcatgtttgtggacattcatgtttctatgtacctggaacttcttattctcaccatcacacagaattttcaagaactagttaagcaaagaaagcaaagcccagcaggtgtcagaattgggtccccaagctgagggtcattagggtgcatgtcagtgtgccaactccaatatccacacctagagaacgcacatcttcccaaaagaaatgaagcacagatgatacttgatcctcaactttgtctccagaaattttttcaggaacttgagttctttatcaaatgctcacatcctacagagaaataaagtgttccattttcaaggttcatgaagctcgtcaatgctgggagcaggcacacacttgtatttttatactcagggatcccaacaggcaactaaaactagacaaggacaaaactccactcaaaatattctgaaagttagctgatgccccatattttattactccaaatgtgtattcacttgcctgagtgctggccatgagcactcagtgaacacttgcagtacagtgagtgatgtccttgacaagttactatgaagactctgagaaaaagtaacatcccccactgtcctcaacaagcctgtaatcccatggctgccagcccttaccatgcaacaacactgcgctaagtgcatcgaaccacacaaaaccctgtgagaaaatactgcttcccacttcacacgtgaagtaactgagtctagttttagaaatacctaaacgaagagggacaggcacaacaaatttgctggaatgtaaagaaagtagatcagtttctgcgtaagcagtaagaaatggcctcatgaggaagaaagggacatttgccctgacatttctcaaagactgcttaggttttggagacagagatccaagggcaggcaagcacaatggttcatgcctgtaattccagcactttgagaggccaaggtgggaggattgcttgagcccaggaattcaagattagcctgtgcaacacagcaagaccccatctctattttaaaaagagagagagagatccaaaagcaaaggcatttcagtttgcaaggccagcatgggagagggtcttaaaacagaaacacacaaggtaagattgggggatggtacctagaccagcctaggatcataggatttgataaaatatgcatttggaaaaacgaatagcatgaacagtattattgataaacccatcattgcatcttaaaggctctgaagtctttagtattgaattaaaaaataattttcactggacaaaaccaaaaggtctttacacaactgtcaagcactttgaaatgattcagcaaaaagcagaataaatcactagtggaatttcaatagcatgtagttgtaaaccatcatgtgtccagcaaaatcacaaaacaagagtttattttagaagggacttagggatattaagaaatataacatacaaaataactaaagttttctccaagcaaaaccaatgatcctttagggatgaacagaaagaaaacaagaaatgcttctttcaaaagttgctaccaaggcttctaagatttctttggaataaagtcactaagatttgcttctgaggtcaatcttgccaacttttccaccatgctttttaggaaggaacaccaggtagggctcaagtactggtttggctcctgtcccattttttggtccttttgtaactccctttactcaactccaagtatgtctgtgcacggacaatgagacgaaagcatgctcaatgcgaaagcacaaattatgtattgagaaatcactacaatgccaaatttttttaaaataaaaaaaaatatatatatatatatatatatatatctttaagaactcgctgtgttagggaaactgtttacatattgaggtgttcctctttttttgactggaacaataaaagaaaaatttgataaaaaann

SEQ ID NO: 386558 - DNA, 369 bp, Homo sapiens
tctgaggagcagagccatttccccagtgtggccagagggcccagacgtatgtgacatctggtttttcaacagcaaagctgatccatttctctacccatcctgggtgtgcagctcccaggctcctctgcgcctctcccagacccagccctcctgcaaggacctggaccctctgaggggcgctggggggacccaggaggaggcagggtgggagccctcatcaggcccccagaagccaggctaatctgcagagccctcgagtggctttgtctccaagctctggtgcatccatggctcccgtcacccgcgtctcatccgcctgcggctccgtctcccttctcgctagcgcatgtcacgttgttccttccatct

SEQ ID NO: 386559 - DNA, 375 bp, Homo sapiens
tttgttaggtgcacagatatcatctatataattttattttaaatattttcaaatagttccaaaattacaatttaaaataaaaattgaaaaggggaagaaagataagtttggatttatgccaagccagatgcatccatccagctttttcaaaattacaaatttttttctttcaaaattacattttaaatgttctgaatattttaaagcgcattctctcacactattcacaacatatagttctaactgcaagggaggaaacatacacagatactcaaaaaataatcttgtctgtaacccatgatttatctttgactactaaataacttgaaaatgtggttccgacatttgcttatttttgtattctaatactcagga

SEQ ID NO: 386560 - DNA, 663 bp, Homo sapiens
tggcggatgcctgtagtcccagcttcctgggaggctgaggcaggagaatcacttgaatccaggagtcggaggctgcagtgagccaagattgtaccactgcactccagcctgggcgacacagcaagattctgtctcaaaaagaaagaagaagtccattctccccaaactgatatacacaatcaatgcaaactcaaacaaaacactagcaacatttttgtggaacattatggttcaaaatatttatcaaatgcaaagagctaagaagtggcaagatacttaaaacaacaacaaaaaaggaacacaatatagaaggattaattctttctggtatcttgtatccagagttattattaatatgaagctatagtaattttaaaactgtggttctcgcacaaaggcacataaaaagaacacaaagttcagaaagaaatgcatacaaatattaacagctgatttatgacatagtgccactgtggaactgagaggaatagtgtcaaaacaaatagatgtctctacttaaaatttaaaaaaataaaaattttttgaaaagaggttgggcacaatgactcatgcctgtaatcccagcaccttgggaggccaaggagggaggactgcgtgaggccaggagttcaagaccagcctgggcaacatagcaaaacccca

SEQ ID NO: 386561 - DNA, 211 bp, Homo sapiens
ctttgaacttcccatggcacgtggggagtgggcatcaagtggatggggctgtaatgtttttaggcactacaatgaactgaatgattatatttctccccagactcatatgttcaaatcctaactccaaatgtgatggtattaggaggtgagacctttgcaaagtgattagatcatgaggatggaaccctcatgaatgggactagtgccctaa

SEQ ID NO: 386562 - DNA, 1005 bp, Homo sapiens
tgagcctgtgggaaggccactggaagctcagcctccgggtggcatgactttgccccttgcatggggcttccctggttggggaccaggcagctgaccagggtggcaggtgttggctcagggaagaggctgctcactcttggcatcttgacccctttgtccaggatcctgctctgcaacatccacttcctgctcccgatctccctgaaggggctgctgctcgtgggcctgctctgcactgtgctgcaagtgagcagtgctaagggggcctccagggggaaataaagtcacagcctgagccggggaaccgcagctcccacaccatcaacaccctcggagggggcaagcagaacctctggcctcctatcaggagcagataaaagaaaggacatcccccttgcacactgattccttggaggcatctgcatctcaccttcatggatcctccctcaggcctcctttccttgtggctccaggatgaccctgtcagagatactggactatcgttcagttgcagaggccccagggcctgtctggacttttccatcccaagaggggctcggctctatcccctttgtgcctgtgaccctctccatcccccacccggctcagaactggcacagccaccaccaaccactcctgattcaacccaagcttcgccctttccacctctcgagctgtgcaacaacaaatgcaggatgctcagccctcatgtgtcagtcccctcaattcacttgtaattaaataacaacacacctctttttctaattttcaaaggtgtatatatttcccctcaataaagttgttaggattatttttctcttccacttacattcttcctgaactctgcctgctcttttttcttccatattttactttaaatacttttttttgaattactatatttcttttcttagctcctttttttggagagatcttgttgtcttaacttctctaagaaggaggggaattttccatctgaactcttcctctattgccttgagcact

SEQ ID NO: 386563 - DNA, 291 bp, Homo sapiens
ctctgcacagcacagggatgctgacggggcctctctgccttctgccacctctgcctcaggagcagataaaagaaaggacatcccccttgcacactgattccttggaggcatctgcatctcaccttcatggatcctccctcaggcctcctttccttgtggctccaggatgaccctgtcagagatactggactatcgttcagttgcagaggccccagggcctgtctggacttttccatcccaagaggggctcggctctatcccctttgtgcctgtgaccctctccatccccca

SEQ ID NO: 386564 - DNA, 585 bp, Homo sapiens
gtgcattctgggtgtccacatatttgttgttgctttaggaagaggagctgggaggttggagtcgccacacatgttgaaagatgtggcaaaaaacaaacaaacaaaacacctcatagagagaaatcctgactttgtgcacaagaaaagggagtgaagtgtgtggggtttttaaagtggtggtgggggggcattaggagatacccagaagctctcaagattccaaacagtctgcttttcttttcagacattacactccaagaaaagaaactctagtgtataacagaggggctctgtcaaaatttaacaacataaatattgggcaaatgaagttgtttctctggtgctatctcaacctgccaatggagaaatatctcaaaaagtcaagaattgaagccattactcagagacagcatcctatggcatggtgatccaaaacaagtacacctctaccttttccctttcagccccaaaccccaaaacactggagaatattggggcaggcaaggcccgtgaataggtgagcagagctggaagaagagactcctgcccctggtgggcctcaggctatttgtggaatgatgtttg

SEQ ID NO: 386565 - DNA, 231 bp, Homo sapiens
ataatggcagtttgaaaattttatgtccatgacagaaatacaaggtacaactttctattttacagccaaaggatttgaagaacctggaaaactttcatgaagagctacaacagtcattcattagcagctgaataatgcctgtatttggaatttaatatatgtattttcttaagatatctgagaatgactcaattaattctatagagaataaaatgttatctgaagacaact

SEQ ID NO: 386566 - DNA, 459 bp, Homo sapiens
agcattactgagctaccaacacaggccatgggcttcaaagctgtttacctactagatctgctgggcttaccctgacccagcatcagtgtctcacaaagtctcctgttgtgaccaaagacatgtccttaaaatgtggctggcctcccaggctgtggtcatggaagaatggagaagtgaccctaaagggtctaatccactgacctttactttgctctaaccaactgcccaaataaataaaaacagcagggtggcgcagtttcccagatgaattccaatttatccctaaatatccaggcttggttcaatgattaaagtcttcagaccatccaaaactctgtcaaatggctctcaacccggggtgattttgcccccaggggacatttggcaatgtctggagacattttgggctgtctcaactggaggaggggatgttactggcatctagtgggtagaggccag

SEQ ID NO: 386567 - DNA, 239 bp, Homo sapiens
ctcaataaataaaatttacttttgttacttataaaaagttaagggaacaataactaaagtaagcctatatatggttctcccatagaagctaatggaatgttttaactaaataaaatgtaacaatacacaaattgtggaattatatctaaaaataattttgtttgcatgatgaaattttacaaaaattattcttttaactacaaatcagctcagattaaatacttcataaactataaaac

SEQ ID NO: 386568 - DNA, 1314 bp, Homo sapiens
tctttggtttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctcgccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagatgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacgctccgccgcgggggtcgcagcggctgccgcgccgtcctcgagtttccagcgtgaggaggaggctgagggcggagaggcgcatcgtgttcgaggcggagaccgagggggagccccgcgcgcggcgtcggtaaacagtcagccccacacaccccctcaaaatctcacaaccacagccccaccaacccctcatgcca

SEQ ID NO: 386569 - DNA, 392 bp, Homo sapiens
cttgtttcctgcacttccaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacacctggttgatttttgtgtttttagtgagacagggtttgaccatgttgtccagactggtctccaactcctgacctcaggtgatccgcccaccttggcctcccaaagtgttgggattacaggcatgagccattgtgccctgcccaatgaatattctttagattt

SEQ ID NO: 386570 - DNA, 3671 bp, Homo sapiens
tctttggtttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctcgccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagatgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacgctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaattggcatctttaggactaagtgtgctctgttgaatgacttaaagtgagctgttcctaagcagtggaagaagaagaatcattcctattcatacaaagtaagattggagcagtcatactggggagattgttttgtgtgaactataacgtgtaagcaactccatgaaaaggcatcttgtttacctttattcagggtggatctcttagccatatgtatgatcctgtctgaacctgtcaacagagcatggagctagtctatttcactatagaaagatttttagacctggggtttaagacagtttttggaacacctagtaagaatatgggacctcacatctagcacagaaatgctctttgccctctgggtggtatgattatatgcccatggaatacagcatgggaaatgatcacttttaggaggatgaacttggattttgaatatttgaaacatctctgagtaaaagattcgatcagataacttgaaacaacatgtagtggttttctcaattagaagataaccaagtgaaggacctgtctttttcctgttcattttacctcattttctactatacatttatcacctttcctttatgtttaaggttgttagaggttatgatagttttaaagatgcagttaggaaggtagaattcaaagtgaagcctccccagtcaggagcgaagatg

SEQ ID NO: 386571 - DNA, 3763 bp, Homo sapiens
tctttggtttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctcgccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagatgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacgctccgccgcgggggtcgcagcggctgccgcgccgtcctcgagtttccagcgtgaggaggaggctgagggcggagaggcgcatcgtggtgactgtctctgtacaaccagcttcaaagtgataatcgtgaggattactggaggacattttgagtgtttcagaaaagttatagaaacccaactattttccactacagtttcttatctctgccctttttggaactcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaattggcatctttaggactaagtgtgctctgttgaatgacttaaagtgagctgttcctaagcagtggaagaagaagaatcattcctattcatacaaagtaagattggagcagtcatactggggagattgttttgtgtgaactataacgtgtaagcaactccatgaaaaggcatcttgtttacctttattcagggtggatctcttagccatatgtatgatcctgtctgaacctgtcaacagagcatggagctagtctatttcactatagaaagatttttagacctggggtttaagacagtttttggaacacctagtaagaatatgggacctcacatctagcacagaaatgctctttgccctctgggtggtatgattatatgcccatggaatacagcatgggaaatgatcacttttaggaggatgaacttggattttgaatatttgaaacatctctgagtaaaagattcgatcagataacttgaaacaacatgtagtggttttctcaattagaagataaccaagtgaaggacctgtctttttcctgttcattttacctcattttctactatacatttatcacctttcctttatgtttaaggttgttagaggttatgatagttttaaagatgcagttaggaaggtagaattcaaagtgaagcctccccagtcaggagcgaagatg

SEQ ID NO: 386572 - DNA, 2109 bp, Homo sapiens
tctttggtttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctcgccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagatgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacgctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccacccatttcgtccataccccctttgcaggaacctgccacaacct

SEQ ID NO: 386573 - DNA, 2363 bp, Homo sapiens
  misc_feature (51)..(51): n is a, c, g, or t
  misc_feature (63)..(63): n is a, c, g, or t
  misc_feature (80)..(80): n is a, c, g, or t
aggatcccccgcgggattgagggtgactgtgaaagtttaaacttcagtgangtcagcagcagntccaaagatgtggagantgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaattggcatctttaggactaagtgtgctctgttgaatgacttaaagtgagctgttcctaagcagtggaagaagaagaatcattcctattcatacaaagtaagattggagcagtcatactggggagattgttttgtgtgaactataacgtgtaagcaactccatgaaaaggcatcttgtttacctttattcagggtggatctcttagccatatgtatgatcctgtctgaacctgtcaacagagcatggagctagtctatttcactatagaaagatttttagacctggggtttaagacagtttttggaacacctagtaagaatatgggacctcacatctagcacagaaatgctctttgccctctgggtggtatgattatatgcccatggaatacagcatgggaaatgatcacttttaggaggatgaacttggattttgaatatttgaaacatctctgagtaaaagattcgatcagataacttgaaacaacatgtagtggttttctcaattagaagataaccaagtgaaggacctgtctttttcctgttcattttacctcattttctactatacatttatcacctttcctttatgtttaaggttgttagaggttatgatagttttaaagatgcagttaggaaggtagaattcaaagtgaagcctccccagtcaggagcgaagatg

SEQ ID NO: 386574 - DNA, 488 bp, Homo sapiens
ggtagtcgttataaaccacgctatggtgaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctccccttatctgccaggctggagtgcaatggtgcattcagcttaccacagcctcaaattcctgggctcgagtgatcctcccacctctgcctcttga

SEQ ID NO: 386575 - DNA, 3032 bp, Homo sapiens
tctttggtttcttgttaaacaaacacctaatttatttcttggaggttttgttcagctgtcctaatttatgactttacattccttctggtgctaaactgctcaagtagcctcttgtatcaagtgtgacctgattccttaagaattttacttaatgagaacctctaagctagaaactcttgctaggtgtttcatgcaccttattttctttaatcattacaacaactctaagattgggttctctccaccttataaatgatgactgttttagagaggttaaggttgcttaaaattggtgagttagtgaggggtagagccacgaatggatttctggtcgctgcctccatcgtcagggcaagcttttcccacgactccagcgcttccatttgtcagtccccaggctagaaagccacagtgctaatttagtatttatcaagcgtttgtagtgtcctgggatctggcacttcgatgagaaagctgtgacggccccaacttctaacagcgagtggtaaggaggacgagggacacaggagggaggagactctcgccaaagcttagcaccaacagaagtggtcccccgcaggttgctctgcgagcgccacctcttccctccaaccgaggagaaagtggcgcgcctttgaggagtccgaggtcccggcccaggcggcagcttgggtcctggcgggttccggacgggcgcctcagggacctggaagcaaccgcaccgaacgcgacggagagcggcgagacgactccaggaggcgcccgagctacatcccccggccacaccaaacccgggtttgctggcagatgcggctcacgacaccccttagggtcgcagcccctcccccggaagtgacgtgtagcgactacggcgtctgggagggacccaggagcagtcggggggtttgagagtggcggcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacgctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacaggtagcttgctcgctctttatggtgtcaccattgctttcatttatttgcccttttaagcaaatccagaatttatacactcaagtttgctttctgttacttaggtttgtcttagaaaggttatgtgtgactgtcatgtgaaagttaccccatttctcatcttaattaggattgctaaaatagaaagtttggagtattttcttaaaaaattcattgctctacaagtaaataaatattttgatttttctatttcctcctaaagaaagtacacacactctctcgctctctctcggtcttataaaactcgttggtgtcttataaaacaaacagtgataatctcaagttagaaaacagtaggtcctgagaaccataagaaaaatgactggtgtgatgttgagtaacaagttggtacagttactttagctatttattaacttgctcatctcatagaacattttaatagatttttcacacacctcattattaaaaaaaaacaaacatgctggtgtcttggttacccattattcctctgtacctgaattcaggttggtttttctatttggaaaagactttataaatgttggcttaaaaagaggttgagcaccagaatctcagaatttaccaccaaagaactcatccatgtaaccaaaaaccacttgtacccccaaaaactattgaaataaaaatttaaaaaatttt

SEQ ID NO: 386576 - DNA, 1119 bp, Homo sapiens
ggtgcttccttaattaactttaattgaagaagttttttttccagacagtgattataaaatacaccagagaggaaaaattattttggcttaaaattcagagcaatatgtattctgcaaggagctggtccaaacaccagaatcttaaacaattatacaaaaggcagatttcatgagcttttatcaattaaggaacaccttttccaaaggtggctcacgcctgtaatcccaacactttgggaggtcaaggtgggcagatcacctgaggtcaggagtttgagaccagcctggccaacatggcgaaaccccgtctctactaaatacacaaagattagcaaggcatggtggcacacgcctgtaatcccagctactcaggtgcctgaggcaggagaatcgcttgaacccggcaggcagaggttgcagtaagtcgagatcccatcactgcactccagcctgggtgacagagtgagattttgtctcaaaaaaaaattgatatattctctcttctttctctattacatattccatatcaatttttataagtctagaaataatacatttatcaaagaccaataaaattacttgaggttaaaaatattaaaagaaaataagtagactgggtgtagagatcaagaatgaaaattatatgaagctattttctgacctgtgtttgtgacaggtcatcaaacatattagacagttgctatgcctcaggcggtaattgcaataactcatgtctcgtcatgtcctctctgaaaaaacaatgtatgtgtggagattacagctagtcctgaaagatgttgccatgagtttacttcacagtctagaggccacaagtaccttgttcaatgaccttcagattgggttttctccggacccttaataccctctgattaaaagccttattatggggatgaaacgtttactgttatattggtaaagtttaggaccttaacaggtagtaggggttgccagtgctgccagattcaatatacagctagccagagttttcttttcaaagataactttacctctatctaagatctcagtccacacaaatataacagcaatagggctatttaccaagagttcaaagcatcatttgatcaaccgctttttttt

SEQ ID NO: 386577 - DNA, 852 bp, Homo sapiens
aacagtagtctaagccaagctagaatcagtttctttactgcagaatttcaggtctttaatatacattgtgaatctctaaatccacgggaaatgatataagaaaataaaagggtttcaaagttagtggctattggtcttctcatccattattaaatgtaacatttagttatatctctctgtatacctgttagagttataattactagtaatatctcctagtattttgtggttcattttcagaaaaactgatttgctctttttattctataggtaagaaaattgggcttgagagagaaaaataatttaatctcatggctaattaaaagcaaaggggattagaacccaagtgagggaactcccaggagactgtttttccattaccctttactattacctcccaatgtgaaattcactttccgaaattacattccttctaatgagcagtggtttgcttcagtctcaattaataattattaatttgtctttaatgtctcagtgttgtatatgtacgtgtatgtatgtttgcataagtttttagatgtaacagaggatattttgttcttgatccaatattttagggctgcatattagcttatctcaattttcgagctagaaaatcacataaaggtgaaatctatttcttcttttgcagcggctctaattagaggaaatcgtaaaaactgtgctcaattttctggctccctcgactggttgatcagcagattggaaagactggaagcttcttcaggtatgttttctagttttttccttgttgtgatagatcactcaaatttgcgcgttgtccccttaattctgcgtgggcgcgtgagcattaataataatatatcttta

SEQ ID NO: 386578 - DNA, 411 bp, Homo sapiens
tactagaaataaaaaagaaaattagttgggcgtggtggcactcgcctttagtgccagttattcgggaggctgaggtgggaggattccttgagcctgggagatggtggctgcaataaactatgattgcactactgcgcttcagcctgggcaacggagcaagactctgtctcaataaaattaaatgaaatacacaagtgaaattgtgagatgtaaatgaaaacaatgaaaggtttttttggactttccttacatgtgattcccgtctctttaaagcatgagacccaatatttttctgggcgtcagtgaaggctctgctcagtataagaaatggtactatgaattgatggtggaccacacagagccctttgtgacagccatttaggtaacagccatttaggtaacagacattag

SEQ ID NO: 386579 - DNA, 1139 bp, Homo sapiens
aacagtagtctaagccaagctagaatcagtttctttactgcagaatttcaggtctttaatatacattgtgaatctctaaatccacgggaaatgatataagaaaataaaagggtttcaaagttagtggctattggtcttctcatccattattaaatgtaacatttagttatatctctctgtatacctgttagagttataattactagtaatatctcctagtattttgtggttcattttcagaaaaactgatttgctctttttattctataggtaagaaaattgggcttgagagagaaaaataatttaatctcatggctaattaaaagcaaaggggattagaacccaagtgagggaactcccaggagactgtttttccattaccctttactattacctcccaatgtgaaattcactttccgaaattacattccttctaatgagcagtggtttgcttcagtctcaattaataattattaatttgtctttaatgtctcagtgttgtatatgtacgtgtatgtatgtttgcataagtttttagatgtaacagaggatattttgttcttgatccaatattttagggctgcatattagcttatctcaattttcgagctagaaaatcacataaaggtgaaatctatttcttcttttgcagcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggctctgctcagtataagaaatggtactatgaattgatggtggaccacacagagccctttgtgacagccatttaggtaacagccatttaggtaacagacattag

SEQ ID NO: 386580 - DNA, 713 bp, Homo sapiens
aaaataaaagggtttcaaagttagtggctattggtcttctcatccattattaaatgtaacatttagttatatctctctgtatacctgttagagttataattactagtaatatctcctagtattttgtggttcattttcagaaaaactgatttgctctttttattctataggtaagaaaattgggcttgagagagaaaaataatttaatctcatggctaattaaaagcaaaggggattagaacccaagtgagggaactcccaggagactgtttttccattaccctttactattacctcccaatgtgaaattcactttccgaaattacattccttctaatgagcagtggtttgcttcagtctcaattaataattattaatttgtctttaatgtctcagtgttgtatatgtacgtgtatgtatgtttgcataagtttttagatgtaacagaggatattttgttcttgatccaatattttagggctgcatattagcttatctcaattttcgagctagaaaatcacataaaggtgaaatctatttcttcttttgcagcggctctaattagaggaaatcgtaaaaactgtgctcaattttctggctccctcgactggttgatcagcagattggaaagactggaagcttcttcaggtatgttttctagttttttccttgttgtgatagatcactcctatttttctttgcttcgtatcctt

SEQ ID NO: 386581 - DNA, 454 bp, Homo sapiens
ttgaccacccatgtacattaaatgagcacggagtatgaaagttgcacgaaattttagaactctgaaggtaaaagtttctataggccaagttcctatacaaaaaaatctctaacaaaaggcctcatctaatgtttcagatggtatttggaaatgcttacgacaaattctgatctgtcattaacttgcttttatatctcagatagtaaagtggtaagaggacacccttgctttacctataattgttctataaatacaggataagtgaaggacacagattcattcatatcatatacttatgattaaaatacctaactaacatgttattggcttatttcatttaacttctatttacccaagcacttttatttaaatagttgtcaaaattaagtgaggaaaatttctaaaccaataaagcctctgtcccatctttttttaacctattatacgacatcta

SEQ ID NO: 386582 - DNA, 431 bp, Homo sapiens
ctggtgccaccagcttaaccacagcacacactgcaactcattcatacgagaaacacatgaaatgtaggctgtgttgagaaataaatagcagaattgtaattaggggccagaggaaaagggtgtgaagaccatgtcaagatttatgcctgtgagatgggttgcagaattgacctgagcagaccaggcttccgagggtcaaaaaagcgtctgaaggagagacactgagtgcattctgggttcacattcccctcctctactgcattcctgaattttctgcctcacagcggcatctgaagcagtggctgtatgtgtccttaaccacccttcaagtccacaacatgtcatattacctcattttggctccctgggactattttggaggacctgaattagtcatgtggggtacttgattaaaaatcacttgaacagcc

SEQ ID NO: 386583 - DNA, 596 bp, Homo sapiens
caaactctgggcccacgggccaaatctgacccatcacctgtttttgtaaagaaactttgatgctgggattacaggcgtgagccaccacactcggcctacgaacttctttattaatgtaatagcgcacatatacttaacttctggtttctacttaagagcatctcaataacctccgatatagaatacgatgaaaaatgaaacctgtgtgcataatgtgcttgtatctacctgtcagaagccctttgctttgatagcatttgctgcctcagtcttcctcatcacccaacctctctgggttgcttgttgtgataaacctaagtgcctccgtaaatggttagagcatgtgtttcttcgtctttgtgacttcccttgtctgggaataagactgcttgtacttctccccagctttgccctctttggcctactagtagcacaccccatcgatccagacctgtctggctctttgtaacatttacctggtcacatgataaagggtgctgagtgcttgccagtgtgggtccctgtcacttctcatgcatgtcctataccttaattttaccacatgtgcttctgcttcttaaaagccattcaaataa

SEQ ID NO: 386584 - DNA, 444 bp, Homo sapiens
ataaaatctttaaatgcccatttgagagggtattatgctgatatcttaactgagatcctttgtgggcaaaacaagtgttcctcattttttaactgtgaataacatcttgcatctgaaaattagaaaataagaggtttcaggttctctctgctaaatccggtttagctactaagaagtgccaaatcatagaactgactctgtgctctgggtggtgtggctttctctgcccttcagagattccaggtcagggttccaggttggcttcctaagtagaaatccatttgtcaaaaccagacaccctcagttagtgaatgtttagggcatgggtttctgcccatgcataggaaaggtcttcccaagtggggcagggctccacaaagaggaggatggccttggaggctggctgacatcctgctttatacctgaacatcttgcaggcagagc

SEQ ID NO: 386585 - DNA, 269 bp, Homo sapiens
tactcccgggtttataaaagatcagagcacttgtcactcttggtgcaggtagagtgagatagagtggttgagcagttcatttttctttataattacactccattaaccttccacatgagagctcccctgtgctttcataccagcagcaccaactggctgcatttgataaggctctacagagtctgcaagaccagcacatgtaacaaaaggaagactttaatactgcagacttaagcagaagctgaacgcagctctgttacttattggca

SEQ ID NO: 386586 - DNA, 317 bp, Homo sapiens
atttatccaaaagtgacaacgttttctcattttttttttttttgccttaggaagaaaatagtaagaagtagatttttcatgtcaagtgtggtgtactgctatttgaaagaaatacaatcttataacagtattatattttaaagacttgctgattctctgtaaggtcacaatatgttttacaagtttcagaagtagggtttcttcattatgagattcataatgttcacagtgtaatctaaaatttaagattctttcattcagtcatgtctttcccctttttgtagggggttggtggtgctaacaagtcatgtaaaagt

SEQ ID NO: 386587 - DNA, 236 bp, Homo sapiens
tttgatttgtatgaagcccaaggtattatcattcatcctttttgtgtcctaggaaatctttgtataacctaagattggaaggattatctcttgtgtttcctcttggagttttataattttttcccccacattttgcttgtgagatcactttaaaaagaaaagcttcacgaatttgcatgtcatctttatacgggggccgtgttatcttctgtgtaatgttccagttttaatatatg

SEQ ID NO: 386588 - DNA, 147 bp, Homo sapiens
  misc_feature (142)..(142): n is a, c, g, or t
ctgaggttttcaggcagctgactgctattgctgtaagcatttccatttggtgtcagctcttggtcattatatttgctttttcctaagttataatcttccatgcctttaagataccctggaagattcagtgagcattctctgnaagac

SEQ ID NO: 386589 - DNA, 493 bp, Homo sapiens
gagactacaggcatgcaccaccactcccagctccaaataaatattcttatcccattttactgatgcagaaaaatgtatggcccagagaagtaatgttaagtttattgggggatttaagttgtaaaaaattattttatcgaaccctaatgtaaactgtggactctgggtgatagtgatgtgtcagtgtaggttcatcgattatagcaaatgcatcattctggtgcaggatgttgacagtgggggaagctgtgtgtgtatgggagtagggagtctatgggaactcttctactttccactcaattttgctgtgagcctaaaactactctaaaaaatgaagtttattaatcaagaaaaaaattcttatgttttatgaatatatgggacagctattcatgtatgtggtaaaaatgaagagatttgttacagtactcggcaggagtgtgtctaatcgactgatattcatgtgtcacttataaaaactggcttcattatc

SEQ ID NO: 386590 - DNA, 493 bp, Homo sapiens
ttagttccaaaactttgatatggcttacaatggaataaaaaagccggaggagtttcagttactgattctcttctaataattctgtgatttgataccatagtgacagggatcaaaaacgtacttataattaatgatgctttcagttgatttgaaaacaaaatttatgtttaattcctccagctccttggttaaattaccatcttgcacataacctcctttccaatataaatgaattgaaaatatcaatctaaaaaataatttaaagccatataacaacatgcttattttggccctaattttactaggctgttttaacccacgttataaaaagaaaaaacataaagcagatggattaagtattataaatatatcataacattttgagtatttaaaaattatatttctaatcactgagctatttcttagtatttaagtatctgctattaaatttttttttggtcctaaatgggttaactttttaatgagattttgt

SEQ ID NO: 386591 - DNA, 217 bp, Homo sapiens
  misc_feature (6)..(6): n is a, c, g, or t
  misc_feature (21)..(21): n is a, c, g, or t
  misc_feature (25)..(25): n is a, c, g, or t
  misc_feature (27)..(29): n is a, c, g, or t
  misc_feature (31)..(31): n is a, c, g, or t
  misc_feature (199)..(199): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (209)..(209): n is a, c, g, or t
  misc_feature (213)..(214): n is a, c, g, or t
aaaggnctgaggatgggggcncttngnnnanggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctncanantntcngccnntcg

SEQ ID NO: 386592 - DNA, 1606 bp, Homo sapiens
tatataaattgtgaggctactacgtggccagagtagtacttgaacttaagtgggctgtattacagaactcatattcaatacacaatgctgtcattcaaagtggttgctttgcatagttacttctttaaattacttctaaacttcaacaagcaaagaatcactttggtgcatgaatggaatgccctgcacctcttcaaatgctcactccaagtccattcatgaggtttactctactcttgtgtatagcctctttggggatgttgtagaactactagagtctttttctagaaattcaatctttaggaaatcattgtcaaagaatggactttaaataggaagaacacttttttttttttttggctatagaatcgtcttaagtgcatgagatatacaaacaatacaaacacacccatgaatatatacacataatgtcaccatatcggtaacttgaggttgttcaaaatgcttatatttagaggaaaatataagagattatcatcattaatagctaccaatattaaatacctgtcatttatttttagtaacatctagaatggccttgatcacttaaaacatcttgccccagtcttacacagtccacaaatttttctttctgttcagaatctgcaaagcattactcttactctgtatctagaatctacctgttaacagctcatatgaataattaaagaaggtttaattttggaattgtacttaatccatcttactgctagtcactgttactgtgagatctgcatcagagagttctgacagtagaatcagcaaaatgaaaaacggctcacagcacaaactcttcctgctaggatttatcactacttaaaaatagcaaatggctgctgctagtatcttaaagacttctcctacctttgtttatctagttaaatttattattacttttcatacatacatactgagcagactgttgtagtaggtgttggtttaaaagttaactaagttactctgcttaatattttccaccattaataggtatattaatttttaggccctaatttcatatttaaaatgtgggctagaattgagacccaaattagtaaaccttgaagactcatgctgtagagtttcaaagtaactgccattgccacacactcttttcagccagccaggtcagaactggctgtgtcatactcttcctcgagcttgactctttggcagtgtcatactttttcccggttgtaggcagaatttacaaccatctaacaaaaagactaaggacccttggattgaaagtttcctaaaatcttttctttttctgggctttttataatagttcaccatcggcttatctaagagataatctaacaatattatatactgtacaagacattatttttctcaaactctgctttttaaaactactattacaaaaaaccctaattactactaaaaaaaacttcataaaaataattattgaatgtgactgcaatttgaaacctcaaaaaattaatatttaatggaataaaatgtataacctaaaaagttttatttagtacaacagaaatgcttactaaaaatcaaaatgttttaaatcctagattatttgacacattttggcttagaaattatt

SEQ ID NO: 386593 - DNA, 965 bp, Homo sapiens
aatgctttataaccattttggaaaaaagaactgtgtagatacacaatggaataggctcctgcatatcagaggggactgacgcatatccacaggttcctctgaaactctgcctgaatggctctagattagacaaggtctcagacccaccctagctctggccttcaacagtcccacaggttctggtctgctctgaagttgccatagtttagttctaaagcttccctctcaccaacctgccctaattgtcatatattacctgctctttccaataagtctcctgctttcctgtccattggccaaattgttacacagccttaccagccataaacataagtgctaccttatatacccatttcattcttaagagtatacttggatattgatacaattaactttgtgtctaattaatacatcttcaagaaattagatgcactaagtctacaaacccttttgaaattttaaggatgtaaaatttgcctgaaaacatcttgctcttgaaaagcttcagattagctcagaccataccatctgcattgatgctgctctgaaactaccaagaaaaggcaatgtagaactctgattggcctgggcttagctcagaccataccatctgcattgatgctgctctgaaactaccaagaaaaggcaatgtagaactctgattggcctgggctccatgtccctttgttccctaacctctaagctccacttcagctccatagctgcaaagaaactcatgacgtgcatcaagagtcaccctttggtcccaaagtgaacactatttgccctgatgcctgcccctgccgtgtctgcgtactgctcaaatatacccatagtgttacacgcaggtaggagagactgttgagaagttctgctatcagaggtgaggacagaggtggtttgttactgatctttagcagtctgagaatcttatcattgtgtgtggcatatgataagaacaagga

SEQ ID NO: 386594 - DNA, 487 bp, Homo sapiens
catgtgagaatcctttgagaccataaaatactttatgattacagctttattattacttttttttttaagcctaattcattctgtggacgcctgcttatcttcatagacagcttcagctgccttgaagttgtcccaaatacagtttggacaaaagctttggagtgcttttctttggagcatttgttaaagaaatcctttttcatattatttgcaaactacagaaaaaaaaaatcaaactctcaaaaagattgtattctaataaagcatgttgcagttcatatcaacgtgtagggaaggtttgaaaaaaggagttacattttgtgccttttcttctgtgtgtatttttcttggtatttcacagtggagagaataacggtacctctagtcatgcctgattgctgtactttaataaaggaacacaggccgaagaaaatgccaaaagtgaagcaggaagaattgtggagggggaagcaagggagaaaaaaaa

SEQ ID NO: 386595 - DNA, 360 bp, Homo sapiens
ggccagagacatataccccataaccctgggggtacttcaggaaccgtgagtgcacagaaggacagcgtccctggaaagggggtctggtattaagtctaaacaaatacataataacaattgcagccatggtaggtaacatttaggtaacatctatatgttactaagcactatatgttgctaagcactgttcttactgttttgcatatgataattcattgaatcctcatagccactctacaagctgggtgctttcataagcttcccttcacagatgtgagagccgaggtatgcagaggttaagttctaaagacaaaacttaacgttaacttttctttctccattaattttagttatggtttt

SEQ ID NO: 386596 - DNA, 1017 bp, Homo sapiens
gaggcggatcgggtattgagtccatggagcgagctgagagctagagtacagaacctgctaaggccatcaaacctatcgatcggaagtcagtccatcagatttgctctgggccggtggtactgagtctaagcactgcggtgaaggagttagtagaaaacagtctggatgctggtgccaccaatattgatctaaagcttaaggactatggagtggatctcattgaagtttcagacaatggatgtggggtagaagaagaaaactttgaaggcttaacgatgtcaccatttctacctgccacgcatcggcgaaggttgggactcgactggtgtttgatcacgatgggaaaatcatccagaaaaccccctacccccaccccagagggaccacagtcagcgtgaagcagttattttctacactacctgtgcaccataaggaatttcaaaggaatattaagaagacgtgcctgtttccccttcgccttctgccgtgattgtcagtttcctgaggcctccccagccatgcttcctgtacagcctgcagaactggaccattgcaagctgcagaaaatgagaagaccctactgaccagcccaagaagacagatgacaagatactgaggatggccgtataagaaaataaacaacttgctaaaactgctgaaactccctctgcttgtgagatttaaaaaaactggctgaaattggttggaaccaacatgtccaatggagtctgaatagaaagagcttgctgacatcacagcccgaatttccaccacatttcatactaactccccctgaatttgcatatgcaaaccacaagcaagcatgatcaaacagacaactgcgcgtgtccgaggactttccagatctcccctttccttccaccaatcacttactaatctgagaatccatcccctaataaaatcactgccttaaagcctgcacaggaagacaaatttgagctggactcagtgtctctttattagtcgacttgcaataaaaaagctttcttttccccc

SEQ ID NO: 386597 - DNA, 969 bp, Homo sapiens
gaggcggatcgggtattgagtccatggagcgagctgagagctagagtacagaacctgctaaggccatcaaacctatcgatcggaagtcagtccatcagatttgctctgggccggtggtactgagtctaagcactgcggtgaaggagttagtagaaaacagtctggatgctggtgccaccaatattgatctaaagcttaaggactatggagtggatctcattgaagtttcagacaatggatgtggggtagaagaagaaaactttgaaggcttaacgatgtcaccatttctacctgccacgcatcggcgaaggttgggactcgactggtgtttgatcacgatgggaaaatcatccagaaaaccccctacccccaccccagagggaccacagtcagcgtgaagcagttattttctacactacctgtgcaccataaggaatttcaaaggaatattaagaaggtgatctcagccctcctccaggcttcgattataacttacaggattgtgattcacacatttcagtttccaccacaggcccctccagacatgtccatctgcctgctgtgttgacttttccctttggagtcttgaggcagctacaagcttactgaccagaaatgaactcaagctctccccgaagcctggtcctcttccaggatcagccagcctggaagatggcactgtcatccaccctgttctcaggcctgccacccaggagtcaaccttagccccatctaattgtcagaggcatctgaaccacagcaactccatcttgagtaggggatgggtaaaatgaggctgagacctgctgggctgcattcccagacagccaaggcattagccacaggataagataggcggtcggtacaagacacaggtcataaagaccttgctgataaaacagttggcagtaaagaagccagccaaaacccactaaaaccaagatggcaacgagagtgacctctggtcgt

SEQ ID NO: 386598 - DNA, 553 bp, Homo sapiens
tgaactcggcagacaaggaccatttttcacacccctatgattgcatccccaaccagttagcagcacccctaccctagccccctgcccaccaaattatcattacctctgaattctcagggagatcaagttgagtaataataaaactccagtctctcattcagctggctgtatgtgaagtaagctctttctctgttgcaattgccctgtcttggtaagtcagctctctctggacagccagcaaaatgaactcattgcacacggttacactctcatctctacctgctgtagactcacctcctctattggagctcatcaaggctgggtctttcctgttctcattttattctctctccttaggtgatctcagccctcctccaggcttcgattataacttacaggattgtgattcacacatttcagtttccaccacaggcccctccagacatgtccatctgcctgctgtgttgacttttccctttggagtcttgaggcagctacaagcttactgaccagaaatgaactcgaacccagtgtgcgatcctctagagcaccg

SEQ ID NO: 386599 - DNA, 575 bp, Homo sapiens
gaggcggatcgggtattgagtccatggagcgagctgagagctagagtacagaacctgctaaggccatcaaacctatcgatcggaagtcagtccatcagatttgctctgggccggtggtactgagtctaagcactgcggtgaaggagttagtagaaaacagtctggatgctggtgccaccaatattgatctaaagcttaaggactatggagtggatctcattgaagtttcagacaatggatgtggggtagaagaagaaaactttgaaggcttaacgatgtcaccatttctacctgccacgcatcggcgaaggttgggactcgactggtgtttgatcacgatgggaaaatcatccagaaaaccccctacccccaccccagagggaccacagtcagcgtgaagcagttattttctacactacctgtgcaccataaggaatttcaaaggaatattaagaagacgtgcctgtttccccttcgccttctgccgtgattgtcagtttcctgaggcctccccagccatgcttcctgtacagcctgcagaactgtgagtcaattaaacctcttttcttcataaa

SEQ ID NO: 386600 - DNA, 554 bp, Homo sapiens
acggcctgagactgtgccgacagcagaattgattcctatgatcctgaatgtaaagtctgagtatcaaatctgcatctcttgggaccattgcaagctgcagaaaatgagaagaccctactgaccagcccaagaagacagatgacaagatactgaggatggccgtataagaaaataaacaacttgctaaaactgctgaaactccctctgcttgtgagatttaaaaaaactggctgaaattggttggaaccaacatgtccaatggagtctgaatagaaagagcttgctgacatcacagcccgaatttccaccacatttcatactaactccccctgaatttgcatatgcaaaccacaagcaagcatgatcaaacagacaactgcgcgtgtccgaggactttccagatctcccctttccttccaccaatcacttactaatctgagaatccatcccctaataaaatcactgccttaaagcctgcacaggaagacaaatttgagctggactcagtgtctctttattagtcgacttgcaataaaaaagctttcttttccccc

SEQ ID NO: 386601 - DNA, 360 bp, Homo sapiens
gagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgtttccccttcgccttctgccgtgattgtcagtttcctgaggcctccccagccatgcttcctgtacagcctgca

SEQ ID NO: 386602 - DNA, 726 bp, Homo sapiens
gaggcggatcgggtattgagtccatggagcgagctgagagctagagtacagaacctgctaaggccatcaaacctatcgatcggaagtcagtccatcagatttgctctgggccggtggtactgagtctaagcactgcggtgaaggagttagtagaaaacagtctggatgctggtgccaccaatattgatctaaagcttaaggactatggagtggatctcattgaagtttcagacaatggatgtggggtagaagaagaaaactttgaaggcttaacgatgtcaccatttctacctgccacgcatcggcgaaggttgggactcgactggtgtttgatcacgatgggaaaatcatccagaaaaccccctacccccaccccagagggaccacagtcagcgtgaagcagttattttctacactacctgtgcaccataaggaatttcaaaggaatattaagaaggagacttacccaaccgtgtccgtatacccctcgcgcctctggcgcgaatgccaagtatcctgcagggcgtcccagacaggagatcccgggcacaccggggcaccgcggcggtcaataagcgctcttgcttccattacaccactaaacgacaacacccgaggggggggccggttccaattgccccaaagtgagtcgttttacctccctgccccagctttcacggtgtgtctgggcccgtggttccccacttatcgcttgggttccctttg

SEQ ID NO: 386603 - DNA, 631 bp, Homo sapiens
atcagaagggaatctggtgatatgtagcagaagccaccagggcctgctccaccagggagaacgcggagcagcagagtcagcggaaggagtgccagtgcgtacacctcctctctgtttacaaagcaaagctgctcgtaagaagtgcgcttgaggaaagagtgcattttacatttcatcacttcatcactctgtttattaaaatctttgttgacttgatatatacattcagaaaagtgcatgtatcaaaagctcactgatttttttatacactggaaacacttgtgtgaaataccactgaaggattcactttaaaatggttgtgtattaatgcaaatttcacctcaacaaacaaaaaaagccccagaactcaagcagccccgcagagcctccttgagctgcattttgttggaagtgtcggggtggaatcaccagggtcaacggtttcccatttccactcccgctggcacgtccgcagacccctgccggtcccacacgcaccccaacacttgctgtcttctcatttctgctgggtgggtggtagtatgatattgtggctttactttgcatttccttgatgtttaatgaacctgagcaccttttcatatgcttctcaggcatttgaagttttata

SEQ ID NO: 386604 - DNA, 458 bp, Homo sapiens
ccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagtaagtgcgcgccccttggctggccccaaaccgcctacccctccccggcccccagttgagccccagagctgccctgccaaagacgacgagcggcagccgggggcctcccttggacttccccgggcggctccctctgcgggggaccgcgcgctccgcagccggcgc

SEQ ID NO: 386605 - DNA, 5907 bp, Homo sapiens
ccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagaactggtgcgcctacatcgtgaacaagaatgtgagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaatagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386606 - DNA, 5723 bp, Homo sapiens
  misc_feature (15)..(15): n is a, c, g, or t
  misc_feature (35)..(35): n is a, c, g, or t
  misc_feature (77)..(77): n is a, c, g, or t
tcccttgcggccgcntcccggggggccgggagcgngcctgtcggaaggtgggaggcggagtcgctcggcatctgggnagagaccaaaggaatgagtcattggaaatgctgaactggtgcgcctacatcgtgaacaagaatgtgagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaatagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386607 - DNA, 4758 bp, Homo sapiens
ctcccttccaccagcctcccttcccagctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386608 - DNA, 4015 bp, Homo sapiens
cgactctagagtgatccccactctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386609 - DNA, 3592 bp, Homo sapiens
ccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagaactggtgcgcctacatcgtgaacaagaatgtgagtgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtcacccgggtcaatccattccatcctttctctgctccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386610 - DNA, 5803 bp, Homo sapiens
ccaggcgcgcgctctccagaggcgcacccgggcaccctccggcgtctgctcggtgaagctcccgcctccgcagagggcgacgggcccccccgaccctcgctcggtctggtgccgcagtcccctctcccctggcctcattgttctccgggtttaccccgtgcccctctccctctctctcctgcaccccaggaactggtgcgcctacatcgtgaacaagaatgtgagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaatagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386611 - DNA, 4880 bp, Homo sapiens
tctagaggagcgtatgggtgctcatccccccagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386612 - DNA, 3940 bp, Homo sapiens
gagcttcctccgttggaagtcccttccgctggcgacgtgggcgctgtggccgcggccctcgtggagcctgagccctcctcacggcctccgcgcagccctggggccccccggcagggtccctcggcagcccgcgggagaggccgtggggccccggcaggagtgtggttcagagacggtgcgggggtcggtggcctcaggtccctttcagtcacttgcgacgcacccgcggtttccgcgtgctgtgaaatcgggaattgttggatgccggagccaagagtgaggccggtttggaaagtgcagccgtctgcgccggagaggctggaaacgccccggccccgggcaggggtccccggcggcgtccgggtggcccgctgcgtcctcggaagatgcgggcggacgcccgtgtgtcccgctggcctgacgtcgcaggggtggccgcagagtcctcacggggaccccgctcgccgggactcatggaggggaccctgacggggcagtcagggctgaggtttcctaatcccgtgtgtttctttctccccgacgcccggcagaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatggaaagccatttccagttaacttttgttaatttaagtgtggtcccttacagatcgggagttgttgctaaaaagcaaactgaagaaatgttttgtttcaaaaagggctacagaaagtaaccttgagtaaaattaatctcagctacaaaactgttacccctccgcatccaagctatacacttgggttttgtttctggcttgtgaagacggaccagatgtgcacggaggtcaaggccccatgtcatctgcagctggagcggctcctctggggatgctgcactcagatcccacagcagctgcccaggctaacttgatccctgctgcttcactgcaccaatctccagcagacacagctcgccgagctcttgggtttctaagcagcaggaagctcaacctaacgctggccacacgctgacagctgagcccatctgagaacacggcatcttcacacagcgagacgcctccactgaggggaggcccgggagtatcaatctgtcaccagtggccacggagacctctcagcacccttagttcaaggtagtctctgtggatcaggttggtaacacctactggttaatcaagtcccactggggaaaggtttggacggtagaatcaagagctgcagtttccttggcccacaagatgctcttatgctgtaaaaaaaatgctttaagaattgtttgcaaatgaatttacagggtggccactggacacttcagagttcctatttactccccccgccacagctaggaagaccagcaagaactaaaggtttgccgttttactatttaaaatgtggacctctttgtccaggagcgggagggagaatggcatctcaccccattacaacagctggggaactggctaaagagagctgtcagagagtatccttggctgtcctaggaatgactcatggaaagcgccccagtgcagcagtgttttcaggaaaacccagtgggcacgcgccatcgccctctcctctcctctcacgctccttttgaaaagaccgcactcggcgcccaaggggacgtgctcaagagctgcaggggcagggcccaggcaaaaggtgggtgatgactacctgctgctttccctactccgtagatgggtctggaacatcgggtaaaacccagtcctcctctcagtgcatctctactcaccaacaatggtgaatctcagctctgtgtattcaagacaggcaaaacagaatatgcctcattatggctggagcgtgcctctactttgagataaagctggatgacaggtggatcctggcccacttaggagacatctttagaaagggaaaggctgtctttttgtacaggtagtagaacaacaaggtcagctgagcttaaggctgtggggttcgaagcagcccttcaagaagtcatcacccctgaagtagtgcctgcgagtcagtcagaggcataccaaaccctgagacagaatcaggcacaagttcacaactttttttttttttggggggagacagtcctactctgtcgcccaggctggagtgcagtagcgcgatctcagctcactgcaacctccgcctcccgggttcaagcaattctcctacctcagcctcccgagtagcggggactacaggtgcatgccgccacgcccggttaattttttgtattttagtagagatggggtttcaccgtgttgcccaggctggtcgcgaactcctgagctcagccaatccgcccacctcggcctcccaaagtgctgggattacaggtatgagccaccatgcccagccaagttcacaacttctgatatcaagttgttgctgagaaaaggtcaggacacttcttaagtagagaaggactgtgacatcccctccaaacctccatgtaacactaacaaatggcctcatttacacgattaaaaacaaaatggtatcgtcaataaatgcaaaccttaaactgc

SEQ ID NO: 386613 - DNA, 4035 bp, Homo sapiens
ccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagaactggtgcgcctacatcgtgaacaagaatgtgagctgctccgtgctggagggaagtgagagttttattcaggctcagtacaactgtgcctggaaccagatgccctgtccgtcggcgctggtgtatcgagtgaacttcagacctagatatgtcactaggtataagacagtgacacagttggaatggaggtgctgtcctggctttagagggggagattgccaagaaggtcccaaagaccccgtgaagaccctccgccccacgccggctcggcctcgaaatagcttgaagaaagccacagataatgaacccagccaattctcagagcccaggaagactttgtccccaactggtacagcacaaccaagctggggggtagatccaaaagaggggcctcaggaacttcaggaaaagaagatacaggtgctagaggagaaggttcttcgactcacaaggacggttcttgacctccagtcttcccttgctggagtgagtgaaaatctcaaacatgccactcaggatgatgccagtagaacacgggcaccagggctcagcagccagcaccccaagcctgacaccactgttagtggagacacagaaacgggccagagtcctggtgtcttcaacactaaggaatctggcatgaaggacatcaagtctgaattggctgaagtcaaagatactctaaagaacaaaagtgacaagctggaagagctggatggaaaagtgaagggctacgaagggcagctcagacagctccaggaagcagctcagggcccgacggtgaccatgacaaccaacgaactctaccaagcctatgtggacagtaagatcgacgccctgagagaggagctcatggagggcatggacagaaagctggctgacctgaaaaactcatgtgagtacaagctcactggcctccagcagcagtgtgatgactatgggagcagctacctgggagtgatagagctcataggggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaaggtggctggggagatgtcaggggaaagatagatagttgtaaaaactctaaagctttaatatattcggtttgtatgtaatggaagcacggggctagagtttccacataggccccaacataaaggccttccctcgctgttgaggccaccatgccttactgcatccagccaggctgcagggagtgaggcacacggtgaacatggccactgacttttctgccactctaactggacaactggaagacttggaaaggcctccacctgtatctacactctgagggccctggactgggcctgagcttgccacagaggctccgtctgactgtgggctgggaggagggaggcaggggagagccggtcacggtggctggtctttactgcagggcagcactgtggccagctgtctgtctttacactgcatgcagaagtttaaacactgaagtgccgaagtggcccgtgccgccgcacagagaccccgactttagtttgggctgttccacgcttggctcaccattgccgcctgggacttaacctgctcaggcgggccttcgcccagctgcaaatagggatgcgttagagactgttcccaaagcttgttgggctccttaaatggcatgtacaatttaagtgcaaagacagggagtgtcaataaagatgaagacctgtcccgttttttttctccccctgtctttttctttggttttttttttgtttgga

SEQ ID NO: 386614 - DNA, 459 bp, Homo sapiens
  misc_feature (459)..(459): n is a, c, g, or t
tggagtttaatctccagccctcaaccctctttctgtaggtcagtaggtggggctgaaagttccagccctgtaatcacctggtccctctgtagctctgtagactggtcctatcatgaggatacccaggggacccacccttagtaatcattagcataaactcaaaagttatcagaggtgatcagtaacaaaagacattctatcacttaagaaattccgatggttttaggaactcaagacaaagaccaaatgtatttcatattataccacactttacttttatcagggaaagaacatttgaacagtccaatagaagataggaatacattttagatcagattctctttcatatgatagcccatcataacaggggctcaaacataaaatgtttattccatgataaaacagaagtgtgtaactagacaatctagggcaaaaatggtagtcagaggaaaaaaaaan

SEQ ID NO: 386615 - DNA, 434 bp, Homo sapiens
ctgcccaccttggcctcccaaagtgctgggattacaggcatgagccactgcacccagccaggtgatggtctttaattagagacttgaatattgaatcaaaaccacagaagattatgttattacagcacaaccctcaccttgaaacgtgaaaaatgtgttaaattattttgctacttttccttttagccaggaactattcaatactttcacaagtacctgtttaactcagcccactacactggccatcataaataaccaaaacgtgatttctttactttctttaaggaaacagtatctcgcacttccagtgttcagtcacatttaataaagatgaatctttctagccgttcaacaccctcacctattttaaaaacaaggaggcagaattttgtgtgatattctctaagtttataaattgtggtgtcctctccgtt

SEQ ID NO: 386616 - DNA, 384 bp, Homo sapiens
atgataggaaggaaattgaattatttagaaagtcactgtgtcctcaatttgtatgaatatttgaagcaagattcatttctcttgttaaatattccattttagtccctacaataatagagattaattttctgttctttttcatcacagagttaggaccagtagtgattattgcatatttggaaattggaaagctgaatgttttacaaaatagaatgagttggttattaatattgattgtgggttcctgagaccacccctcttacttttaacatctcttggtttaaacatatttgttttaagtagaactcctttccttttctcattcttaattactttcttgaggcagaattcctgatattcaaaattaatttttatcaatatatt

SEQ ID NO: 386617 - DNA, 377 bp, Homo sapiens
tatgctgagtgaaataagccttataaaaaaagaatagactgtaaggttctatttacatgaaatctagaataggcaaaaataatttataatggaaaaaattcagaacagtggttgctggtggctgggggtaagaatggaaagggagcacaatagaacttttgggggtgattataatattgtgtaattctgtatcttgacagagattcatagtacatagacatatacatttgtcatatctcacaaatggtacacataaaatttacacattttactttatggcatttcacatttaaaaatgtaaactttgaatttatttaattttgaattaatttttttttgagatgaggtcttgctatattgcccaggctggtctcgaa

SEQ ID NO: 386618 - DNA, 509 bp, Homo sapiens
ttcattatttattaacttcattcaataaatagttacattgtacctactacatgccaggcactatgttagtgagtttgttcactcagtcagccagctctgtaacatggaaagaaatgggaacaatttcacctatctcatagccacctgaaatagctcagcatagatagttttctgttcatttgcttctcaggctgttccctcactcactcattcactcattcatttgcttattcatcaagtacccattgagggcattctgggtgctgaaccctgtgctgggtaggcactgtgcgggtgtgagttgtgttctgaagggtgaaggctgaggatcttgagagcccagaggagggatccagcccgacccgagggaccaggaagagtggtctggaaccagcaccctttggacctaggctagaggccgagcaggaaccattgaggagagaggcaggaggtcagtggcccaggcgggaaccctcacacccaagccccaacatttttattttgttttg

SEQ ID NO: 386619 - DNA, 387 bp, Homo sapiens
tcaaggctgtagttcttatttttaagatgttgcttttctggaatcttatttaactgaatgccagaggggctcagcaagaactctctacttttattgagttggaactactccatctacccacatatgacctctgatatctgatatctccagttaccttagtcctaaagcagctatctcccgttacctcttagtcctaaagcagcctttctttcttttctttctctctctctccttccttctttccttccttccttccttccttccttccttccttccttccttccttccttcctctctttctctctctttctctctttctttcttagacagaatctcactctgtctccaggctggagtgcagtggcgtgatcatggctgactgcaacc

SEQ ID NO: 386620 - DNA, 584 bp, Homo sapiens
caactagaaaatcaaatgggcgtcattttcacttaccccacaccacccttacccaactcctcatcacctcaccaaggcccttcttaggtttctaagccaatgctcattcagttttgcaagttacttcttaaacatacagtgacatctttaataactacatttgcaaatccaaatttctttgatattgtaagaaaagagcatttgtctttgaatagaagctctttcattggctgaatctgttcctttaaataatttagatccccttaatataaacttatgagatataaaactttctaaggctttttaatctaaaaactggatttactcttaggggatgtagtggagaagtgatgatgagtaattaaaggtcattctcaaacaaaaatatgtatttagaatcaggtcttctagattgaccaaaacatatgtggcaatgtatactttgatattataattgcttggagtttattttaggagacaattctccagagagttgatggatatctttgtgcattatcctattccttggcctttcttactgtgtagttaaaggatattaggattgctcaatcagaaaaatgata

SEQ ID NO: 386621 - DNA, 294 bp, Homo sapiens
accatgtccggctaatttttaaattttttatagcaacagggtcccactctgttgcccaggctggtttcaaactcctgggttcaagtgatgcttctgccttggcctgtcaaagtgttgggcttacactttgggcgtaacccaccatgcccagccaattattttttacgtgtattttttggtggcagggtggggtgggggcagggtcgggtgggggcagggtctcgctctgtcacccaggctggagtgcagtggcgtgatcgtggctcactgccttaagctcctgggctcaagtga

SEQ ID NO: 386622 - DNA, 718 bp, Homo sapiens
aagggcccaagtagggaatttctgtgcttatttgactcacctcaggagcaaatctctttctcccctaccattgcttttaccctgcaagggattcagtttcctgattataagttctgaggcactggatcctatttcttgagggaggcagagaccaaaacctttgaaatatgagacccactaaacgagcacagaatagagtttggtctgtccctttgttctgtctctgacagtagtagcaagagatgctttatgggaagaacacagtagctgccttcggtgaagtcaatttctaaaggttagggatgtgagcctctttgacttgccctgtaataactcattctggctccatcattcatgtgagctcctctaagcccttctggaacttatttattctttcagtctttattggattccaaaggatagaagcaacccctgagacttgtggttgagttgtgccctcatccatcagctgtggactccaatggtgaagtaatgttctctgtagaaaattatctgctggggttcttttcttggctctgccactagaaagctatgaccctgagtgaagtccttcaatctctctgagcctaggtttcctagcctagaaaacagaagtgggagcatctggcaatgcctagttcatggggtggctgcattctgaaggcagggactgtaccccattcatcattgcatccccagggcctgacatggtccctgg

SEQ ID NO: 386623 - DNA, 258 bp, Homo sapiens
atgcagggggcactgttgtaggctcatttggtcctctcaggtagcaaattgtaatccatagtgtaggatcagaagacacaaaggctgaggaaagactactagctcctagacttttaaggaatgggcagaggaagggaaaccaataagctaccaacagtgtaagagaagatcagagcaggatatcacaaaagctggggtaagagaatatttccagaaagagaaagtgattaaaagtgccacatattggccgggcatggt

SEQ ID NO: 386624 - DNA, 126 bp, Homo sapiens
ccttacgttcttccttccttctcttcttccttccttcctttattctttccttcctctttcttgttattttacccttcaaaagtgggttttaaagtttctatatacaataaatcactgctactttat

SEQ ID NO: 386625 - DNA, 195 bp, Homo sapiens
agtttacattgttgggtgctgaaattctgtatttctttgaagagtgttgaatcttttctgttggacttttacttgcagattagtttgatccttttgaggtatgttctaggctcttttagcgtgttctagagtagcatttatttgagaaataatttagccccacttcaaactgttgcctttccaggatttttactg

SEQ ID NO: 386626 - DNA, 250 bp, Homo sapiens
atgcttagtagcgtcacgtggctagtagctaccattttggatcatatagaatagaacatttttatcattgcagaaagttctatcagatgacactaatctagactttcatttataataagctgaaaatgaaatatgattagatattgtgaagataattaacggattcaaaacaaagggcccctcccaaaagttaacatagaaacaaaataactttttagctcctgggtgatcacaagaaacttaaaaagag

SEQ ID NO: 386627 - DNA, 705 bp, Homo sapiens
gtgaaaccttgtctcttctaaaatacaaaagttagccaggcatggtggtgtgcatctgtaatcccagctacttgggaggctgaggcaggagaattgcttgaacccgggaggcagaggttgcagtgagccaagattgtgccactacactccagcgtgggcaacagagcgagactccctctaaaaaaaaaatatgtaaatatatatattatatatatatacttcaacctatgaagttgtaattaccaaattgaccattttttagttattttaaaagtaaattgagtatagagttaagaaaataattcaaaattgctacgtaaaaattgctctccatttaagagtgtaggctacaggttttagataactacattatattttaataaaccaaaaggtatgtgtttgtatatagtttgccaagattcagaagtttttgagaaacaattacattttctcttcaaagtttaggtactctgacattcttttctaacctgtggttttgatgaatgtgccatgaaaaaagtgttctgtgtggaaacgaatttgggaaatgcagagttagatggataaagagtacatatattcacatatttatgaagcatttctgaacaactaatgtttctaacaggacaaccagtttcatttcaaactttttttttggatacactttttttgtagggattacatttataagcattttagatatat

SEQ ID NO: 386628 - DNA, 1406 bp, Homo sapiens
ggcacgaggctggttccctggcaggctggagggcaggagctggggccacgctggtctgggatagttgggcagggagacggagtctcgatctgtcacccaggctggagtgcagtggcacaaccttggctcactgcaacctccgcctcccgggttcaagtgattctcctgcctcagccttctgagtagctggaattacaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 386629 - DNA, 1266 bp, Homo sapiens
ggcacgaggctggttccctggcaggctggagggcaggagctggggccacgctggtctgggatagttgggcagggagacggagtctcgatctgtcacccaggctggagtgcagtggcacaaccttggctcactgcaacctccgcctcccgggttcaagtgattctcctgcctcagccttctgagtagctggaattacaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 386630 - DNA, 1283 bp, Homo sapiens
ggcacgaggctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgtcttgtccctctgcccctcccccctcctcaaggtagtggccttggatagcctgtttgtgaataaagacaattcagccagctcccaaaattatgaagtg

SEQ ID NO: 386631 - DNA, 1127 bp, Homo sapiens
ggcacgaggctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctgggtgagtgatccctgtcctccacctgggctcagagacccacgaagtccctgcatcctctagcaagagtgtgttctgtcttatctgtatcctcagcaccaggcactggctaggtgtgcagttactgtgcactaagtgcacgtcgagtagatggaagggggtgaggataaagaaggagtgtatcttgctgtctctagcccccagactttcatacatgctgctcctctctctggctgg

SEQ ID NO: 386632 - DNA, 1284 bp, Homo sapiens
ggcacgaggctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 386633 - DNA, 1416 bp, Homo sapiens
ggcacgaggctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattgagattacgaatgctatggatcctatctttccatgtcagtgagctcacaggagacacaccacaatcctgttgccacttctgtaataaagtgactccaagccccaaaaacacttacacgaaaactctccagcgct

SEQ ID NO: 386634 - DNA, 571 bp, Homo sapiens
tggttcttcttccctttccttcctctctccatcccccgatcctggcagatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattgagattacgaatgctatggatcctatctttccatgtcagtgagctcacaggagacacaccacaatcctgttgccacttctgtaataaagtgactccaagccccaaaaacacttacacgaaaactctccagcgct

SEQ ID NO: 386635 - DNA, 982 bp, Homo sapiens
agcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaatgag

SEQ ID NO: 386636 - DNA, 913 bp, Homo sapiens
aggaaatgggagaaaggaccggccaaacaagagggttaaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaatgag

SEQ ID NO: 386637 - DNA, 820 bp, Homo sapiens
aggaaatgggagaaaggaccggccaaacaagagggttaaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaatgag

SEQ ID NO: 386638 - DNA, 824 bp, Homo sapiens
tgcattttcctttcctccccgagcttctttccatttccacaccacagctgggctttgtcccatgctatgccctgcactcaaaggtgtgctttgactcacactgatttcacagctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgtgagcgctctgtctcttgaatgtgcttcatattgtgtgaggggtatcctatggaggggttcagaatccctcagggtcgggctgctggctagcctggaaaacttcagggtaacgccccctgccttctgaggtcctgttaaccctgcacccctggcccccaggacttcctgcgctgtgtcagtgccatcatcatcttcctggtggtctcctttgcagctgtgacctcccgggacggagctgccattgctgcttttgtgagttcagccctgcaggactccttagcccctcaagagctcaggctggtgcttgcacactttctgtatcagaagccacagccaggacttggggttctggcttgcacctcaccctataccttaacccaatggccctatagcctctgttttgccatccccactcccactcccacaggtttttggcatcatcctggtttccatctttgcctatgatgccttcaagatctaccggactgagatggcacccggggccagcc

SEQ ID NO: 386639 - DNA, 1952 bp, Homo sapiens
agcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtaacagctgcctcccaacctggtgcctccatctccctgacccccggctcctggccagccttatgccagcccccagctcacccttcagtagcctccttccccaagccctctggacacctctcctgcccgcagctgccccttcttcgtctcctactctgccttcttgctgcctctccacccggagacatttacagcaggtttcagttgcagcaggaaggactgcagttagacagggtgactttttgggacattgaggaagcttgagacatagggatgggacaggggcaatgacagcctctaacatggccacttctcagcacgtccaagaagtctaactatcaaaaagggcagacttcctgcaactgcactttatctgtggtctgctgcccagaaacatctcttctcaggaaaggatcttcccctggttacttagcaagaccacagtgtagagttaaggcctctgcacgtatgccaccctaggtcatcagagctaaagggctcccagaaaccactgggcagcatctgccttctctcttggcatggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattctaaaaatgag

SEQ ID NO: 386640 - DNA, 1725 bp, Homo sapiens
agcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtaacagctgcctcccaacctggtgcctccatctccctgacccccggctcctggccagccttatgccagcccccagctcacccttcagtagcctccttccccaagccctctggacacctctcctgcccgcagctgccccttcttcgtctcctactctgccttcttgctgcctctccacccggagacatttacagcaggtttcagttgcagcaggaaggactgcagttagacagggtgactttttgggacattgaggaagcttgagacatagggatgggacaggggcaatgacagcctctaacatggccacttctcagcacgtccaagaagtctaactatcaaaaagggcagacttcctgcaactgcactttatctgtggtctgctgcccagaaacatctcttctcaggaaaggatcttcccctggttacttagcaagaccacagtgtagagttaaggcctctgcacgtatgccaccctaggtcatcagagctaaagggctcccagaaaccactgggcagcatctgccttctctcttggcatggaatcaaaggctctggtccttgtcagggggctttcaggcatctgggggtggggaaagcattatgaggcagggggctcctcttggtccctgtggagtcgggtctctgtgggcacaactccaggggctggcattcacactgtacctatgaattactgtgggatagtgctcctgggagccatatggcttggccagactgctggggttgctgggtgagcagagtgggaggccggagactgcccttgaccggcaaatgccctgcaacggtggctcctgacaccaggggatagggagatgtgccagagtccttcctcccctccaaggacaggtagtaggtgccagcctaggggagcttccaaggaggggaaggcaaagccctggcccctgcctgtgtccccttcttggcatgttccacatgctcggtcctgcaggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtgaggaaccctgacccctagcccagtttggggcccttccctctcctctaaatgatgcattttcctttcctccccgagcttctttccatttccacaccacagctgggctttgtcccatgctatgccctgcactcaaaggtgtgctttgactcacactgatttcacagctgcagggccacgggcaatcaggaggaccacatccgctagatctactctcccactcagcaaaggtccagccccagccctggcctggcttga

SEQ ID NO: 386641 - DNA, 425 bp, Homo sapiens
ctatggctgactctcgaggatccacgaaagtattcacaacacatatatctgacaaaggacttgtatcctgaatatttaaactactccaactttgttactacacaatgtatgagtttagcacattacaggacgcacatgaactttgaaatctattagccaattagaagaatatgtctttacatctttcaaaaagaataggtaaaaagaaataatatattttcagttataaatattttcatccaagtcagtgtagaaaaatattgactagaaaattaagataaaacttcaacctaaaactacagaaaaagaacctttcaatgtttaaagttttgttatgttcctttatttgagatgctttgctgttcttcctatgtaagacatcacatagcttcctagtggtaaactttgcttttaaaatttctcac

SEQ ID NO: 386642 - DNA, 1066 bp, Homo sapiens
gccttttcagaaaaagtttgcaggaatttcctctgcccttggagcaaccattgaaaaaagaagaggaaataatttaacatgttaataaaataaatcaaatgtatttaaaaacagttaagagaagttaggaagaagagaaaaaggaacaaaaaactgatgggataaatagaaaataaatagcaaggtggtaagtttaaatctaaccatattgatgactgcattaaatataaatggactgctgaggtgtgaagattgcttgaggccaagagttcaagaccaacctggccaacacagcgagaccctgtctcaattttttttaattaaaaaaatataaatggactaagcacgttaattaagaaactgagatggttagagtgattaaaaaaaaaagaccaaatgagcgtaaaagaaatgcaatttaaatgaaaagacacagttttaacatttaaagagctaggtgagatggttcactcttgtaggcccagcttgtcaggatgctgaagtaggaggattacttgaatgtagaaggttgagactgcagtgagccatgattgattgcaccagtgtactccagcccaggctgcagagtgagaccctatttaaaaaaaaataaaaagaaaaaaaagaaaagaaaatagctaattgttttggatttgggtcataaaatgatggaacagaaattgggtttagttaattatgcctatgaattaatttatggatcccatattctcagagtttatccttaaagacagtcttaaagtccttaagaaaataaagagagaacggccaggcgtattggctcacacctgtaatcccagcactttgggaggccgaggcaggcggatcacaagatcaggagatcgagaccttcctaacacagtgaaaccctgtctctactaaaaatccacaaccaaagttagctgggtgtggtggcggacgcctgtagtcccagctactggggaggctgaggcgggagaatggcatgaatccaggaggcggagcttgcagtgagccgagattgcaccactgcactccagcctgggcgacagagtgagactctgtctca

SEQ ID NO: 386643 - DNA, 389 bp, Homo sapiens
ctgtctcttatctgggcaagctttagacatactagcttggttggaaactgatattaaaagcctaaaacatgtaacttttcttatcaggttactatcatggggaactaaagattcctggttttttgtatgttccataactatactttagtaagccctgatatacggtgttaatttttcttcagtgaaggaaacatgaagatatatttatgtgcacacatacatatatatgtatatataacgtatattcaaacatgcactcagaggaagttagggagagaagtttctagctaaacatgatcttgtgaaattcttccatatgtggaaaagtcgtcagttcatctgacatagagcaatacatacatatatacacacaggatgctatgtataca

SEQ ID NO: 386644 - DNA, 402 bp, Homo sapiens
ttccgcctcccaaagtgctgggattacaggcatgagccactgcgcctggtcaatttcccacattttcttaagattatgtttggcctacaaaagctcaacccaaagctatcttatcaagctggtatggaatctttatttcagcaaggtgatatccccaatatgtaattcaaccttttgtttattccaataattagtacgcaggtgctattttaactaaaattgtgttaaatttgagataaaatcaatgtatttttgtaattttgttttcaccctgaaaattggtcctactataagacaagatgggatcacccttcctgtgatggctggctccggtggaagcctgcgtggggctcccatacccctcaccctcctggacagatcgtcaccctgtctctgcttaaa

SEQ ID NO: 386645 - DNA, 836 bp, Homo sapiens
gatttaagaaacagttttattctataggaaacatactaagtaattgatatatgtgttgtggaaggttactgaactgggagacatgttatcttagttctagtctgcattctatagaaacaatttacataacctttggtaagttgcttaacctctctggagctgttcatccatttataaaatgaaggtattgaactaaatgacctctaaaattcaatttagctctactattgcatggtttaatgactctatgataattttttccattagagaaagtacagtcaagaaaggcattttagaacttgtagcaaaattttttttaattctcctgaatttaaaaaatgttatccacttataaataatgttttaaagtttatgtagatgcctctcagatggtccctgaacagtaagtggcaaatgaagctgtcctaaaatagaggttccttaatttcagtgtttggggtttcttcccaaactcagtttccttactaaagtgatcaaaatactcctatagtgaaaaacctcttccttttatgtcttaactgtgactgttaggtaagttttgaagataaataattttttttctataatcagatgattttctatgtctagtcatgcatccatataatcatccttttttctgcctcataaatcatctgatgttttttcctaagaccttttatgggtttggctggtcagagtcatcctgagaggaatcagcatcagtggtggtcatgggatggtcatagatactagtttgggtcctatggagataatatttttgataagcagctgtggtattgcaagccatacagcagtgaatgtcctgtaataataac

SEQ ID NO: 386646 - DNA, 408 bp, Homo sapiens
gtttttttgtttgttttttggagtgtttgtttgtttgtttggagtgtttgtctctgtctgtcgcccggactggatcacagctcactgcagcctcgacctcttgggctcaagcagtcttcccaccaggtagctgggactacaggcttacaccaccaggctaggctaatttttgtattttttgtagagatggggtttcgcctttgccacgtggctcaggctggtctcaatttcctgggctcaagtgatcttcccacctcagcctcccaaagtcctgggattacaggcatgagccaccgcgcctggccagattttctttttcttttctttcttttttttttttactttgataacaacatgacatttcatgtcactggattacaatttgttctttttctaacattttcactg

SEQ ID NO: 386647 - DNA, 539 bp, Homo sapiens
cagtagcaattgtcatctgtgtaaataaggttattgatttctaaaaggtctatgtttaatcagatggattagtcattctgtctttcacacctgtggtgactaattcaaaggaaaagccctatcattttgccagctggtgtttaagagttgctttgttttctgtgaaaccaggtgtactgcattagaaaagtttattcaacttttaatcattaagcattgtgataaattgtaaacttagaaattgtttggtttactgtattaaaaatgttggattcctgtaattccagcattttgggaggctgaggtgggaggattgcttgagttcaagagttcaagaccagtctgggcaacatggtaggaccccatctctacaaaaaggaaaaaacaatttggcctgggagtgcacgcttgtggtcccagctacccaggaagttaaggtgggaggtttacttgagcccagaaggttgaggctgtgatgagccatgatcgtttcattgcactctagcctgggcaacagagtgagaccctgtctcaaaaaa

SEQ ID NO: 386648 - DNA, 459 bp, Homo sapiens
catcagaattcttttactagattaccagtcatccttcaggtatccttctctgagatcctaagatagatttacgtccttcttcgtgctcctcttgtgcagaatctgaccatagtagttaacttcatatggtaacttaactgtttaacagattcctccactacactccatgaaaacaaagactgagttttaaatcaagtctctggttcctaaccagcacctgatacattataggctttagtttaaatgtatgaataagcctgggtgcgatggctcatgcctgtaatcccagcactttgggaggccaaggtgggaggatcacttgagtccaggagtttgagaccagcctgggtaacatagtgagaccctgtctctacaaattatcaaaaattagctgggcattgtggtacatgcctgtagttctagctacttgggaggctgaaacaggctaattgcttgagc

SEQ ID NO: 386649 - DNA, 344 bp, Homo sapiens
tgaaatgcacatctgagaggtgcgtaaggagaccgcagggacacgctctgggaaacagggcaaagccaacagggatttgggattagcagaagtcctgtggcatcaagcagcccgacagccaggagaccagccaacacttgtgccaacgtggtcaggagagacatggcagacgcatgtcctggctccaggcattcaggcagaagggaagcaaacactactgaacacacctccacatgacctgggccgtagggtgtccctgcagaacccacccaatcacagctcgcatttcttttctttctttctttcttttttttttttttgagacagtctcgttctgtcgccca

SEQ ID NO: 386650 - DNA, 403 bp, Homo sapiens
tacaaagaatgaaagtagattagtagtggttgcttaaagctaaaggtgtttaaaggaaatacagaggggactgctaaaggacaaggagtgataaaaatgttctaaaattgtgattgttgtgtaattctgggaattcactaagaaaccattgaagtgtacattttatatgtgtgaattatatggtatgcaaatgatagtaagcacacatagacacatgtataatgtgggacaccattaagggcaacatatgtgtaatgaaaaattttttaagtagtcaaagaaataatgactagaaacttcccaagtttggtgaaaaacatattttcagaagctcaacatactccaagtaggataaatgcaaagagattcaaaagtagacatgttattgtcagaatgttgaaag

SEQ ID NO: 386651 - DNA, 420 bp, Homo sapiens
ggtactaatgagtggcccatcaccaggacaaaactttttttcatgccagtataacagtttcctaaaatcatagctttgtatcaaagaacgtatgcataggactgcatttcttcattactgatatttttggtgattgccctgatcttgtttacctggttgatcttcctgtcaggttccactttcaaaggaaagcaactgtatggcaagtacaacttacttacctgcaaatgggtgaatagttgtaactgaattcatagaagactggtgtaggttcagttcactttgtcacgttcccatatctcatgttccacttacactgttgggctttcccatcattcctgtcatctgcgccagggacagcaagtggggcagaacctaacttgactgtgtcactggagagagctggtcactgcaaaccct

SEQ ID NO: 386652 - DNA, 522 bp, Homo sapiens
tctccatggcctggtggccctgccctgaagcgtggtgggcttccgaggcactggcacacgcagctcaccctgagcatcagtaagccttctctgcagccaacccctagcatggatagcttgggcacaaggggatgggaatgaggagcttcctcctcctggcccctggaagagggagaagagagcatttactgaccactaagcactctgtgcccagcatgggagcaggtgcttcacatgcattatggttaagtgatccttatcacttttcaccttatgatgcagatatttgaaatcattctattttacagatgagaacacagaggctcaggaaagtgaagcagcttggcctacggtttcacaaatggaaaatgttagagctgggtcacacacagaggtctgctggctccagagcctgagctttggctttcagggtctcagtttctcacttataaaatgggtatgacaaaaaaaatccctccttcacagtgttcttgtgagcattaaaaaagtagcaatgttaac

SEQ ID NO: 386653 - DNA, 1481 bp, Homo sapiens
ttcaaactagatgttctagagagcactagctgcaatcacattgggagactgatgctccatgacagctaaaagttggattgagtttcaggagctactatatataaagctgggtcgacttatgtcactgcactaattaaatgccatctgggtggttcctctgggtttttgagtccatcacccagttcagatcgagtcagaggccaaggaggagaacatgatgatggacctttttgaaactggctcctatttcttctacttggatggggaaaatgttactctgcagccattagaagtggcagaaggctctcctttgtatccagggagtgatggtaccttgtccccctgccaggaccaaatgcccccggaagcggggagcgacagcagcggagaggaacatgtcctggcgcccccgggcctgcagcctccacactgccccggccagtgtctgatctgggcttgcaagacctgcaagagaaaatctgcccccactgaccggcgaaaagccgccaccctgcgcgaaaggaggaggctaaagaaaatcaacgaggccttcgaggcactgaagcggcgaactgtggccaaccccaaccagaggctgcccaaggtggagattctgcggagcgccatcagctatattgagcggctgcaggacctgctgcaccggctggatcagcaggagaagatgcaggagctgggggtggaccccttcagctacagacccaaacaagaaaatcttgagggtgcggatttcctgcgcacctgcagctcccagtggccaagtgtttccgatcattccagggggctcgtgataacggctaaggaaggaggagcaagtattgattcgtcagcctcgagtagccttcgatgcctttcttccatcgtggacagtatttcctcggaggaacgcaaactcccctgcgtggaggaagtggtggagaagtaactgagcctgcgcttgagaccttctccacgcagcaggaagatcccaccgacccttcctggcctaatcctttagattaggtcacattacattaacatttaggaacccagaccgaaaagttgctgaaagggaaggagacacattcacaaagaaacgttgcgaaaattgcgaaatctgttgtgcatgctcaaatgaaaacgcctttcggctttgggcttttatttttttggaactgcgagtggcttaggtctagcctcattttgtttttgtttggttggttttatactatattaacttttattacggtgatccttttgtgccatgttcaaaagaagttcattcctgtctaaagtgggaaagttgcatttaatgttaggggtatttaatgtatttttgtaaatagtttaacactttctttttttacgtaaacctgaaatatattttaaatgtggaatgatgtatataaaatgtgcgaggatcctggtattgtaatattaaaaagaagtttctatatgaaaaaagttggtcctaatttgatgga

SEQ ID NO: 386654 - DNA, 344 bp, Homo sapiens
tcaatctcttcatttgtccagtgcccaaagtcttttctggttctaaaagaccatgattccaaattattgttagtgacctacatatatgcatgcatgcatgcatgcatacacatacacacatatgtatagtgactattgtactgggtttgacaacaggtaaaggcagtgtcttataaatattacatattttatgaaaaccaaacagcctttgtgtttaagtcagaaggaacatatggttcacatacagtctaattttcaaatagctgtgcattgaaattcttgatctacaggatagattcatatttgtgcagatattaactttttatgagtattcattgtttttc

SEQ ID NO: 386655 - DNA, 137 bp, Homo sapiens
tcatctgggagaaggatcaaatcctgccatctggatgtgcattattaatgctggtgtttggtgaggaagctcctaggaatgcatagatctctccttctgccatagtatgtcgtgtgtagtggatgccagtagacaac

SEQ ID NO: 386656 - DNA, 705 bp, Homo sapiens
cgccccctttctcctttagctgccaccggctgctctgtctagcttctcacctgctggcttttcagcttcaactcctggctaatgagtgaagaaggtcactgtaggagtgtgaggaccatcaggagcttcatatttcaataaccagtgccaaattctgaatgccagatgggatgagatgggatgttaaaccacttcttattaccatgttgttggcctccattgccttcgtattggtctccaattgcatggtctctgtggatctctgacttcttattacctccgattggaacgcgccacaaatcatcctgctttctttatcctctctcacctccaagtaatcctgtcatcttgctccaattagagccgcttccattaagaagatcgtgacaaattccctacccctgtttgctcttcaggaaaattatcccctggaaaagtggatgttatagtcgcttttcagaatgtattgtctgaatttcttgtcttccaacattctcctaagccagttacctttgcactgaagtagaattcaaaaggagatagaggttctgaatttcttcctttgaccagatggaagtcgttacatcagaatgctgatgactgcaaaatcttggacatattgttttcacaattaggaaatggcaaacacaaagttcttcagtgcaaagccagcatgcgagttcagcttccatttgctgctataaa

SEQ ID NO: 386657 - DNA, 621 bp, Homo sapiens
tcagctcggtaccccacttatgcgtgggcttcattctaaagtgtctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaatagcaaattgaagatttacttatctaggacttgaattccttctttgggtccaagttaataaaagaccaagaaactc

SEQ ID NO: 386658 - DNA, 858 bp, Homo sapiens
  misc_feature (53)..(53): n is a, c, g, or t
accatcacatgggtagggattttccatccagagccaataaaaggactggtggnggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagccgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaatagcaaattgaagatttacttatctaggacttgaattccttctttgggtccaagttaataaaagaccaagaaactc

SEQ ID NO: 386659 - DNA, 524 bp, Homo sapiens
aaaaaattcttccccaaatctgagattactgatgctccaagaagaaatgtgcctcctgaccctaggttttaagtaccattgttttactgtcttgttacttagcaggaagagtatggatccatggcaaggatgttagacggtttcatccagatgaatatcagtgatacttaggaactgcctctgtgaggtggttacatttgtttctctgtttgactttcacaagagtcttgacctacactggggaatcaaatcatacttttgtcttgtgggggaatcaaatcatactcctgtcttggaggaaaatcaaataatctaatctttttcactgcttcagtttctttccctgtaggacctgctgatatgaaaagtcaggccttcatatctgcagattctatatccctcaaatactgtatttccaattcatggttggttgaatcagaggatgtggaacctgtggatatggaaggcttgactgtactgtactttttatcattattttagagagtactccttctacttactaa

SEQ ID NO: 386660 - DNA, 586 bp, Homo sapiens
gcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaact

SEQ ID NO: 386661 - DNA, 479 bp, Homo sapiens
cagtgctggccgctgtcattaagcacacacagcttccacagggcagcagagtggctcctgggcagatcctaggggagcaggctctgttgcttgggcacactcccttttttactatgtgctagctatgtggcctggagcaatagattgaacctttctgtacctaagctttctcatctatgaaaagtggagataatgataatagtacctccctcagagggctgttgttgggactaactgtgccaagtcatgtggagtgtttagcaaagtgtctggctcatattaagtactcagtaaatgtcagcttttactattccccggctggaaggaaccctaaaaacaatatgccccctattttttaaagagacattgaagctaacagatgttcttttctcccttaagtttttagggcctttatttctgaattttagaaaggaagataggattctttatctctcccttaaataaaaacacatttcagt

SEQ ID NO: 386662 - DNA, 414 bp, Homo sapiens
ccatctctactaaaaatacaaaaattagccaggcatgatggcatgcacctgtaatcccggctactcagggggctgaggcaggagaactgcttgaacccgggaggtggaggttgcagtgagccaagatcgccccattgcactccagcctagtgacagagcaagactctgtttcaaaaaaaaaaaaatttttttttaaaaaaagaacaacttctgaaccaaacacctactgtagcacagctcctcaaagccctttccagatgggaagctgcccaggaaatatctcacccactacaaccatacagccatctcttgggtggagtgaggcaggtgttctgcccagagctgcatactgacctggggcaggaagcaaaaagtgctgagttaaaactagtccttagaggtagagcttgtcca

SEQ ID NO: 386663 - DNA, 411 bp, Homo sapiens
cacatatttaatgtgtttccatgtcaaaatactatttaagttaagacttgattgagtctgttaggtaccagagtcactcactcattactttaatttcaaatgctacagtttgaaaacttaatgtatgcttggttgttaaaaaaaaaaaagcagtgggaagaatagaagttgtgttagaatacaaggtacattttattttcaccagaaaggaaaaatattgttgtaagattataaatagcacgaaaggcttattttaattattttaaaaatatgatacctttccactgcagtacctggatttcaagctctgactcaggggtgtccagtcttttggcttccttgggccatagtggaagaagaattgtcttgggccacatataaaacacactaacaatagatagctcatgaact

SEQ ID NO: 386664 - DNA, 461 bp, Homo sapiens
tgggtaattttttgtctccttttgggtgctttgcaagtcactgactgtagcagcaggcaactaatggccaacagcattctgacagtgcttgctgacaggcgataatgagattagtgccttttgattccattattaacaagtagccaaagaatcatttggacatgtcaggagctaatgataggaattaagggtccctctaactttggggcagcagttcaggtacctgatgctttgaagactaattgcagacattttttcctaaatgttttaaaataaatgtttttgctgacatagaacatacatccaaaaaagtgcacaaatccgaagtgtccagctcgattaattatcacaaagtgaacacagcagtgtcatcactattcaggttaggatatagaatattcctggcacccagaaccagagacctctcctcttgctggtcccagtcaccgcttgtacccttt

SEQ ID NO: 386665 - DNA, 375 bp, Homo sapiens
gccccgactgcacccgacgggccttccctcgacgagagcggctccagcagtgaggcggagttggagaccctcaatgacgagcccccggtgcgctgggcgcaggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttag

SEQ ID NO: 386666 - DNA, 517 bp, Homo sapiens
ctgggaagaagaggaaaatatatttagacgaacaaccagaaatctatttctattctctggaagagcttgtataagataagaaatacttgaatcatgggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacagttttgaaggctgagaagtccaagatcaagatgctgaaagatccggttctggtgaaggccctcttcctgatttggagatggcctttttcttgctgtgttttcagatggcagggagcagagagagcaagagcgcactttcacatctcttcttataaaggcactaattccattcatgagag

SEQ ID NO: 386667 - DNA, 1001 bp, Homo sapiens
ctgggaagaagaggaaaatatatttagacgaacaaccagaaatctatttctattctctggaagagcttgtataagataagaaatacttgaatcatgggtttttttaattacttgacctattttcttgctgctggtgctgtcactttgggaattggtttctttgctttggcatcagctttgtggttcctgatttgcaaacgaagagaaatatttcaaaattccaaatttaaagcaattgatgagagatgcaggcaaagaccatcaatggcgaagattaaatctcattctcagtgtgtttttatttctcgaaattttcatactgggagattccaattacaggaggagcaaagaaaaaaggaagcagcacatataaaagcaattaaagatcattctaaagatgaaccccaacttgcaacaaaaaatatcatttgtgatccctcagagaccagctccacaacaaatcgcagcagtgttacattaagcttatcaacattaccatctgattcttattacagccaaagtatagaagcagctgatgactggttttctgatgattctctagtgaaaaggaactctccaatgccttctctcggggaacctctaatggaaaaagtattttcatacctgtcaaccatttcattagaagagggtactgaaagtgtactgaatgacactttatgaccatcaaaaagatgactacattaagggaaaatgttcatgaagaaacacagaggttgaaatataaaaccttcaacataatactgaatgacttttttcttttgaaaccttgtatacaatcagcttctgagtctcttaacatgtccatgctaatattgctttttttgttctttaccatagagcggctctacttcccttgctggttcttatttctagaaacaaaattaggaagaactagagtgatgtcatgaacattaagcttaacttattgtatctcatccaaagacatattaaataaaatgagtgtatgtcaacaaacggga

SEQ ID NO: 386668 - DNA, 150 bp, Homo sapiens
cccctatgcggacaggggcagagctgtgtctaactaccaaaaacccacttggccataagggaggtggggccgaacatgtcctaggaacacagctgtattctcactacaaggactactccagccgctgtcatgggggcagctgcctgcggg

SEQ ID NO: 386669 - DNA, 467 bp, Homo sapiens
ggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttagg

SEQ ID NO: 386670 - DNA, 698 bp, Homo sapiens
ctgagtcagtcaccctttggccggacaggcggttcccgggcgcggaggatggaaacctggcggtaacctctgcaggtcgtgccactcggtgtgcgcaaggtctccagaggcatcttttcatttttagggggcactttccacgaattcatttgagctacacagcagtcctgggcagtggggagtggtgagctccattgtgtacacttggaagcagcccagaaagttcactgaggcagatgggaggcccggaggagaaagaatgaaggaaggcatttcagcccgagtaaactccccaggcccgctctgtgccaggcagtgttgcaagcctcgggtagggtgcttctagcacggtgctttgtgcacagtaaacactccagcggctgttgaccaatgaatgaatgaagattgtaggctcaaatattcaagttatcaaagtgcaaagaatgagaggttgtttgcactggacttaaaaaataaatagcctggacctgtactgtcttatacaacagctatgagctactggtatgtggctagtccaaactgaaatgccctttaagagtaaaacacacactggatttcaaagacttagtacaaagaaaaaatgcaaaatagctcattagtaatttttatgttaatgacatgttgaaataacattttgatatattaagtaaaatatagtattagaattaaaaaaaact

SEQ ID NO: 386671 - DNA, 775 bp, Homo sapiens
ctgagtcagtcaccctttggccggacaggcggttcccgggcgcggaggatggaaacctggcggtaacctctgcaggtcgtgccactcggtgtgcgcaaggtctccagaggcatcttttcatttttagggggcactttccacgaattcatttgagctacacagcagtcctgggcagtggggagtggtgagctccattgtgtacacttggaagcagcccagaaaggtgaagacctgttcgtgaactccagaggccattggaagcatggaaggctatggctggcactcttcctctttttccagttcactgaggcagatgggaggcccggaggagaaagaatgaaggaaggcatttcagcccgagtaaactccccaggcccgctctgtgccaggcagtgttgcaagcctcgggtagggtgcttctagcacggtgctttgtgcacagtaaacactccagcggctgttgaccaatgaatgaatgaagattgtaggctcaaatattcaagttatcaaagtgcaaagaatgagaggttgtttgcactggacttaaaaaataaatagcctggacctgtactgtcttatacaacagctatgagctactggtatgtggctagtccaaactgaaatgccctttaagagtaaaacacacactggatttcaaagacttagtacaaagaaaaaatgcaaaatagctcattagtaatttttatgttaatgacatgttgaaataacattttgatatattaagtaaaatatagtattagaattaaaaaaaact

SEQ ID NO: 386672 - DNA, 582 bp, Homo sapiens
ctgagtcagtcaccctttggccggacaggcggttcccgggcgcggaggatggaaacctggcggtaacctctgcaggtcgtgccactcggtgtgcgcaaggtctccagaggcatcttttcatttttagggggcactttccacgaattcatttgagctacacagcagtcctgggcagtggggagtggtgagctccattgtgtacacttggaagcagcccagaaagcttctagcacggtgctttgtgcacagtaaacactccagcggctgttgaccaatgaatgaatgaagattgtaggctcaaatattcaagttatcaaagtgcaaagaatgagaggttgtttgcactggacttaaaaaataaatagcctggacctgtactgtcttatacaacagctatgagctactggtatgtggctagtccaaactgaaatgccctttaagagtaaaacacacactggatttcaaagacttagtacaaagaaaaaatgcaaaatagctcattagtaatttttatgttaatgacatgttgaaataacattttgatatattaagtaaaatatagtattagaattaaaaaaaact

SEQ ID NO: 386673 - DNA, 1298 bp, Homo sapiens
ctgagtcagtcaccctttggccggacaggcggttcccgggcgcggaggatggaaacctggcggtaacctctgcaggtcgtgccactcggtgtgcgcaaggtctccagaggcatcttttcatttttagggggcactttccacgaattcatttgagctacacagcagtcctgggcagtggggagtggtgagctccattgtgtacacttggaagcagcccagaaaggtgaagacctgttcgtgaactccagaggccattggaagcatggaaggctatggctggcactcttcctctttttccagttcactgaggcagatgggaggcccggaggagaaagaatgaaggaaggcatttcagcccgagtaaactccccaggcccgctctgtgccaggcagtgttgcaagcctcgggtagggtggtgagcaaagcagatggccctgccctcactcagcaaccagtgtaggggagctgccacggttaccagcaaaagctgaaatccagcgccatttgcatttcatatggaattttaggaagttttcgagatgttttagtttagaagctaaacatgacataccaggttcttctctgtctggccttgcatacctatccagttccctctccattcatctctgccctgacatgcactcaggaggctccctgggcctcagcattcctcatttgcgcgcctctggtcaagctagtacctctgaatgccctttcccatccccttctcagagttcacctcacacattccgaagccagctcagggccacctctgaaacatttagagcactcccctgcccatccagatgctcattaaatagtgtgcatctctgtcaccgttctttcatgttattttataattgtctctttatgtgtctctcacccccacagactgagccttagggcaaacaatgtcttgttcacttttgtccttccagcttctagcacggtgctttgtgcacagtaaacactccagcggctgttgaccaatgaatgaatgaagattgtaggctcaaatattcaagttatcaaagtgcaaagaatgagaggttgtttgcactggacttaaaaaataaatagcctggacctgtactgtcttatacaacagctatgagctactggtatgtggctagtccaaactgaaatgccctttaagagtaaaacacacactggatttcaaagacttagtacaaagaaaaaatgcaaaatagctcattagtaatttttatgttaatgacatgttgaaataacattttgatatattaagtaaaatatagtattagaattaaaaaaaact

SEQ ID NO: 386674 - DNA, 190 bp, Homo sapiens
ttcccccattgaatgatcttggcatctttctcaaaaagcagttgaccatagttgtacggttttatttctggactttcaattctgttccattgatctatatgtcttatgccggtaccatactgttttgattaccattggtttgtagtaaattttgaaatcaggaagcatttgagtcctctccttcttcttc

SEQ ID NO: 386675 - DNA, 248 bp, Homo sapiens
tttgactcatgtagaaaagacatctaacattattcatccaaaaagttggcagtggacttttgcgtggtcccatgggaaggtcacagacgctttgataacactgcgtggtagccattagcattcggactagtcacaagttaccgttttcatagggcatttacccttgtatcttatttatcctgtattagaacatactaacttatgtgtgtcctctttattttattctctcttatggcagtgtttctgga

SEQ ID NO: 386676 - DNA, 1828 bp, Homo sapiens
catgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacattaaaa

SEQ ID NO: 386677 - DNA, 698 bp, Homo sapiens
aatgaagagccaaacaagtagagggtgttcactaattaactggttagttaattacaccctgttgcctccgaagaacatcctaaagctgtgtccaatgatgtataaaatacagtacagcagttaaacatagctgcaaaagaatgggaacaaatgattgcagggaaacaaagcacacctaacaaagaagctaatacaaagacatataatagggaaattttagctttctagagggcaaatcaatgaaagaggaaacctggtaaaaagggaaacttctgataccagcaagttaaaatagagcatttgctgtggaaaaacatttgacatagtgaccaattctctggatctcaatggagaggaatcggtgtatttactataagcagtgtccttaacagaatcattgggataaacacggtgatgagttgtgcagggtcattttatatctggctttggtcctggccctaactacatccccctctccattataggagggctgatctgtctttacaaataacatacttggttgggaatataaatctttagtattagctctgtaagaaccatctgttaagaatagttgtatccatcccaaacaaagcataaaaatgcatgatttttcactgagtttagagctgtgtcagaagctgtcttgagtatcttttggtaactgggaaccttccactccacatacagaggaggga

SEQ ID NO: 386678 - DNA, 736 bp, Homo sapiens
gaaactttgtctcaaaaaaaaaaaaaaaaaaaaaaaggtaccatgtagtagtaacaggttatttgaaggctctctaaatggtcttaattaaaatataaacaaaattatgtatatgacttaattattcttttgcctttccggattcttaaggacagatcatggtgaaaaacagttattacaggtaaagtggtgtgaattgtttgctttgagggtaaagtaattggtcagttggacaaggtagtcaggtgtgccctggagggtggagagaagtcagcttggaataaaaaattaactgaacctgggcaacatggtgaaaccccttctctacaaaaaaatacaaaaattagctaggcgtggtggcctgtaatcccagctacccaggaggctgaggtgggagtatcgcctaagctcgggaggtgaaagccgcagtgagatgtgatcatgccactgcactccagcctgggcaacagagtgagaccttctgtcagaaaacaaacaaacaaacaaaaaactgtgattcactatggagtcgaaaagaaggaaggtagactctctgactttcctgagttaggatgatgtggacgtacacactctttgctttaagaagatgttcttggccaggcgcagtggctcacgcctgtaatcccagcactttgggaggccgaggtgggcggatcatgaggtcaggagatcgagaccatcctggctaacacagtgaaaccccgcctctactaaa

SEQ ID NO: 386679 - DNA, 354 bp, Homo sapiens
  misc_feature (29)..(29): n is a, c, g, or t
tccgtgtggttcttgtagctggggtaatnccaggactgaacaaggacagcaatcacgaacctaaaggtgataaaacatacttggaaatgaagttatttgacttatataccttcactttcaaaagtccagagcaagagcatccaaaaatgtggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaaccagcaaagaaccacag

SEQ ID NO: 386680 - DNA, 443 bp, Homo sapiens
taattagtacagtatttacctttaagggactgaacaaggacagcaatcacgaacctaaaggtgataaaacatacttggaaatgaagttatttgacttatataccttcactttcaaaagtccagagcaagagcatccaaaaatgtgatttcataaactaatttctgttgatggatcttgtagcttttgtgggtacacaaagtaggacgagtcttcttggttacgttggaggaaaaaggtatgtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaaccagcaaagaaccacag

SEQ ID NO: 386681 - DNA, 537 bp, Homo sapiens
tgaattcataaccttagacatttagtggttgaaagagttaatagcaataaaatatgaactatttacagtggcaaatatatatctatatctagtggtatgtatctgtctatgtatgtacctatagatatatatatctttgagttttaagacttgaccatagcctatttaattcaaataatataggagatatttcacaatcactgactggaatcttcctagcatagtatatgtatcagcagaaatcactataacaaagagaatctaatgtaaatcttggcatactggttactaaatgtagttttataaagggcaatctaataaatgtctttggtttccaaggtgctaacaacagattggaataataaacccttctgttctcggaaaccagaaatgtctttaggaatcctggcaaaggaaaaaaaaaatctctgtaatctgatcaagcccaaacatttgcaaaagaaaattaacttacataacactggcccagatcttattatttagaaccatttttgagatcatgaggcatatattttg

SEQ ID NO: 386682 - DNA, 6061 bp, Homo sapiens
ggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccataacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaattctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagtcaggtggtatgccctactgggaagatacaaaacagactatcctgctgtattcttttttttttttttttgagatggagtcttgctctgttgcccatgctggagtgcattggcacaatctcggctcatggcaagctccgcctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaagataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattggaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagc

SEQ ID NO: 386683 - DNA, 6004 bp, Homo sapiens
ggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcaggattcacactgggtagaagataaacaacttttcattaagagaaaccaggagcttttagaaaagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccataacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaattctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagtcaggtggtatgccctactgggaagatacaaaacagactatcctgctgtattcttttttttttttttttgagatggagtcttgctctgttgcccatgctggagtgcattggcacaatctcggctcatggcaagctccgcctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaagataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattggaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagc

SEQ ID NO: 386684 - DNA, 5574 bp, Homo sapiens
ggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctggatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatgagagaaaaaataacatcccatccacccctgaagaaattaaaatctctgaatgacctcgaccaagctaatgaagaacaagaaacagagtttctaaaacttcaggtcattgagcaacagaacattattgatgagctcacaagggaccgagaaaagctcatccgtagaagaaagcatagaagaagttccaagccaattaagaggcctgttttggacccgtttattggctatgatgaggactctatggattcagagacatcatccatggcctcatttagaacagacagaacaccagctactcctgatgatgacttggatgaaagtttagcagctgaagaatctgaactaagatttcgacaattaacaaaagaatatcaggccctccaaagagcatatgccctcctacaggagcagacgggaggcatcatcgacgctgaacgagaagccaaggctcaagaacagctccaagcagaggtgctaaggtataaagccaaaattgaagacctggaagcgactctggctcagaaagggcagatagaaaaacaggaggcagaaaatcaccggttacaacaagaactacaggacgccagagaccagaatgagctgctggagtttcgaaacctagagctagaagagagagagagacgatcccctccatttaatctccaaattcacccattctcagatggtgtgagtgctctacagatctactgtatgaaagaaggtgttaaggatgtgaacatccctgatctcataaagcagcttgatatcttgggtgataatgggaatttaagaaatgaagaacaagtggccataattcaggccagcactgtgctgtccctggcagagaagtggatccagcagattgaaggagctgaggctgccctacaccagaaaatgatggaattggaaagtgacatggaacagttctgcaaaataaaaggctatctggaggaagaactagactacagaaaacaagctcttgaccaagcatatatgagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcagagaattcgtgacttagaagataaaacagacatccagaaaagacaaataaaagacttagaagaaaagtttctgtttctattcttgttcttctctcttgcctttattctatggccttgatgtcaaggtgcctcttaaagagtaaccgaaaacatggataagatcccaggaagacaagtgcttctaaaccttcaaagatggcaaaattgtttacaccagtgagagggagatcaaaagctaagaactaccctgtagccaggactacaactgtgtattttaaagccattattcaaggtttcttacttgacagttcctacacaaccctgttgaaaatctacaatatatgctgcatttaatgaaacatgtatatgtcaaatcagaagagaagaactataaacatatattgtgtaaagaaaaagttcagcaatggaactagtttctgcagatcaagcaaagatgtgtcttgggcatggaaccaaagttacaatgaaatattcaacccctgctgtgcaggggggtcattttaatgtaacaccacaccccatggaaacactagtcctgataataaacatcattttaaaagatcaaaacaaacaaacaaaaaaaacaagggtgggtggggagtgaagcacgaggaatacctatgaagagctatttacaataaaatgtttcatttgaaaagtctggtttcttactacagggatttgcttttctgtctttatgattgttttaaactcaggaacagagacatccgcatcgtaaatgggaagaaaaacactctctgttttgtttttctgcaaaaggtggagcttgtggaattcattccacagacgacagatgagaagtggatcacagtgaccataacaaaactggtaacgaagtcaaaggacccgagcgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtagataacagaacaacctcaatttttcaaatttttgaagttttatttatggggctagaattcccatgcatagagaatatgtgtagggagccagaaattctttctatgaaatgctatacaaatctttccatatgtgggttcactatcatccttcagttttagcactggcatttgcaaagccagaacaataactgaagaatgtacaataaaaactagaatgctggggtcccactttttgttcttacatttactgctgacccaggtatctttggcccagtcacttaacctctctgtgcctcagtttcctcatctgcaaaatggggttaaaatgctttttcataaagttttatttgcaattttagaacaagaggtgcttaaagtagcacaatgtgctttgtaattattacaagtgctgtattatttgactttcttgtgttgttgacaaaaagattccctcatgtaataaaatagtgcttcagtttggttaaatttaagcactatagcactgaagcttgcttatcaagctacttgggacattattagcaataaaaattgagagattcaaaaccaggatctttaataatctataggaaatagatcatctcatgctattgaacaagatagaagagtgtgtcatttctatgataagcatctcccagctctcttgattgcatatgcatgccatcatacagaaccccacttttaccacaggagagccagtcattaaacaaaggcttggagcaaactgacagtatcacataattagcttgattatcttttattctggaggaaagtcaggtggtatgccctactgggaagatacaaaacagactatcctgctgtattcttttttttttttttttgagatggagtcttgctctgttgcccatgctggagtgcattggcacaatctcggctcatggcaagctccgcctcctggattcaagtgattctcctgcctcaacctccctagtagctgggattacaggtgcacaccaccacacctggctaatttttgtatttttagtagagacagggtttcactatgctggtcaggctggtctcgaactcctgacctcaagtgatctgcctgcctcagcctcccaaagtgctaggattacaggtgtaagccactgtgcccggcctcctgctggattctttattcaactaggtaggttccagattaaatatgagccatatgctcattaggcaagaaatgtgaaagagggtgcctctacagtgttggtgacccaacactagccaacttgagtcagaaaatatggaagaagataaattactctcacatatctaagacttttccatttttcttcactttctgttgcagggcccatatgagtaaatctatattccgtctgctccaacacacaccttccttctcttaattttgctttcccacccaccaagaaatttgtaagtcaaaatttatttccatgagtaactatttctaaatgattggaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagc

SEQ ID NO: 386685 - DNA, 667 bp, Homo sapiens
ccttttccttcgatgcattttttctcagataaatcacaaacaacctaatccaatgaactctttcgaatggagttcagctgcttcaaactgactcaaggaacagggtaaaaataagatagatgaaattaatgctaaccacctttaaaaaaatggtactgcactatagttttctacatggcagtcaaaattcaatcaggtcagaattttgctaattagaataaaattggttgattctttatatttattacctattacttttttatacctgaaagcctatcacaattgaaaaaaaaaagatttggcagtcatgagaagaaagttaatgagaatattccaagtcttttactacatgctagactctttcatacacagtctgtttatcctgaagatcagctcagcctatgaagtaggaatttattatctccattttgcaactagcaaaattaagaatgatctgttaagtacctgacccaagttcacacagcatgtaagaagcaaaattgaaacttaaaactaggtgtgccagattgaaaacatcccaaggaagttcaggccctaaaatgtcttcctctaacttcatgttcaggcactgatggaataggaggccacatttgtctttgacatgagtttctgcttgattttgcaggatgtgaacatccctgatctc

SEQ ID NO: 386686 - DNA, 1466 bp, Homo sapiens
ggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggaaaatggattcagtttgcatctctccctcctttaaacagcttctccgggtctcagcatgggcttccagggcagcgattgaggagaccttaccaaggagcaccacacagtagatgctgagacatcgtactccaggataagaaacagtaacatggcagcacctgcttgaaagaaattaaaaaccaacagactccatttagaaaggaacaatgtccaagaaagggcgaaataagggcgagaagcccgaggcactcattgttgcccttcaagctgccaatgaagacctcaggaccaagctcacagacattcagatagagctgcatcaagagaagtccaaggtatcaaagcttgaaagagagaagactcaagaagcgaagaggattcgtgagctggagcagcgcaagcacacggtgctggtgacagaactcaaagccaagctccatgaggagaagatgaaggagctgcaggctgtgagggagaaccttatcaagcagcacgagcaggaaatgtcaaggacggtgaaggtacgtgatggagagatccagaggctcaagtctgctctctgtgctctccgcgacggcagcagtgacaaagtaaggacagcgctcaccattgaggcccgggaggaggcccggaaactgtttgacacagagcgccttaagctcttacaggaaattgcggacctgaaaacggccaagaagcaggtggacgaggctctgagcaatatgatccaagcagataaaatcaaggctggggaccttcggagtgagcatcagtcccaccaagaagccatctcgaagatcaagtgggagtcggagcgggatattcggaggctgatggatgaaatcaaagccaaggacaggatcatcttttccctggaaaaggaactggagacccagacaggctatgtacagaaactccaacttcagaaggaggctttggacgaacaactctttctggtcaaggaggctgagtgcaacatgagcagcccaaaacgagaaattccaggaagggcaggtgatggttccgaacactgcagcagtcctgatttgcgaagaaatcaaaagagaatagctgaattgaatgccactataagaaaattagaagacaggaataccttgcttggagatgaacgaaatgaactgttaaaacgtgtgcgggaaaccgaaaagcaatgtaaacctctcctggaaaggaacaagtgcctcgccaagagaaacgatgaactgatggtgtccttgcagcgcatggaagaaaaactaaaagccgttaccaaggaaaattcagaaatg

SEQ ID NO: 386687 - DNA, 372 bp, Homo sapiens
gctcttaggaaaaagctcagattccctgtctggcaggcagggcccttcctgacctaaccagagaggcaaagtcatctttgagagagttctgaggctgagaaaaagctcactaagggatgggggcgtggggagcatttcagggacagggaaatgtgatttcaaaggtggggagatatgatggaacctcccatctgggaaaaatcagaaagcagatatggcaggaggctggagtgagtgtccagggtgtattaggtacacctagtgtgttccaggctctgttctcatgctgaagatgcagcagtgaccaaaacaaacatccctgccctcaggagctggcatttagcagaggaaggtggcaatcagcaatgagca

SEQ ID NO: 386688 - DNA, 554 bp, Homo sapiens
tggaatttgctcctgggtcccctaggccctagtgaggggaggagagagaacccatcctctcccttcttacactgtgaggccaagcagaagccaggggtgctgccctctcccacggtgccaacgcctttgtgtgttgtgtatgtgagccatcccacatgtgagggaaataaacccctggcacttaaaaaacaaacaaaaaaacgcattttaaagaaagaaaaatagtaatgtaatttgcccaaggatacagttcttaaagttaggatttgaatccagatcagtgttgctccaaaacctgttaaatcacacaatccctatcatcttgtgcattcgtttgcttctgaattgttagtcaaggaatttttaactgccaacaacatgatgaaaacaatgttactgcacagagttgatacaattttagacagaaaaaagaaacttgatattttggttacctaatccattcattcattaaaaaaaaatttagtgctgggcttggtggctcacaactgtgtaatcccggcattttgggaggccgaggcaagaggattaccttt

SEQ ID NO: 386689 - DNA, 437 bp, Homo sapiens
ataagattgaatatggcaaattcttaatgatctggggaacaacagtttttaagtctgggaataacatgtgaaaccagcagctacatttctaagtggcatctccattctcactgttggtgaacgttaaactgttgcaaattcattttatttttaacctaaaaaaactgaaatcacaaattacctaggagaaatcaatcacatgacgcactccaaagttaaaggtacgtcagcgtcagctcccctgactctctgtcagtggctgattctccactcccacccaccagccatctcgattctgcactccagtgcttttcagtcttctagactctgctgaactatgagagaaatctggggcttcaacaaagtcagtgccaactttttaaacttaccttaccaagttagaggaaaaaacaaaacaccacgtaccatcagaatca

SEQ ID NO: 386690 - DNA, 518 bp, Homo sapiens
ctccatctcaaaaaaaaaagaaagaaaaataagcatcttttctcagagtgtcttagtaagctgctgaaaaggacaaaagactcttaaaatggtaatttgcacagtgtatttgatttaaggtctctttgagtatttttgtacccaatacagagggtaacaggaaatagaattaactgagaaaaagcccctgctgcatctgttgtgtgcctagtatcattttcagatcaccaagtcagatttaggatgcatttaaaatgtgtgtatcaaaaatatttagctctccggattgaagtctactctccatccattctctgggcaaatactgactgagaacttactgtgtataatgtagtctggatctgggaaaggaaataaagatgggtaacagtgggtccccacctcaggtaggttttcagctgccctcaagaatcttgggatccagggttgtagaataaatacaatattttattacatcagtaaaagtcatctccaaactgttatttttcttttatgtattc

SEQ ID NO: 386691 - DNA, 315 bp, Homo sapiens
agtccacattaaggtttgtgaagcctcattctgagacaccactggttgggtgtcgtttccaaaaaccagtgccagaggccgtgtgatctaatagcgatcattacccatagctttatgcatgtatctatttgtgtgtaccctgctcccaccttactgagcatttgagccagttgctattcaattagataaaaagcatccacagaggaggtggcaaataagggtttaaataacaagatgaacgcaagtcactcagggcgcataacttctggagagctattgtacaacctggcgatatagttaacaatcatgtattac

SEQ ID NO: 386692 - DNA, 400 bp, Homo sapiens
ttgtgtgtgtgtgcgtgtgtgtgtgtaacttaaagttccctctcctcctagctaactttaacttttatcgatttatggctgatattcctatgacactctggtgcatctgtctacagatatttctattttttatattacacttatttaatattcttcattaatcttcattaattcattaatttaattaattggacctttttgttttactccttatatcgcgtaacttcttttatatactttacattgctttgttttcgagttcacattctaggaaacttattcagccaaatagcttggttttactaaaagtttttttcaattctgtatcaactgcaatctaaccatttcattgattctgggtacacaattttaaaaaaaactttgttttgcagttgttcta

SEQ ID NO: 386693 - DNA, 980 bp, Homo sapiens
caggaagtatcagcatggcattaggttgttgtgagagattcagctcttctgcagtgccttgtcaaacgacctgactggtcaactgggaaaatgaagttctcagggccaacatcgtatttgggtgtttttcttttaggtctgtatcaaagccagatttaagaaggagggtgtctacaaatgaacgaaagcagaggatgtctggggacaagctaaggacatttgtgtcccacactgcatgtattctgaatccagagaaaagagacaaacttcttgggagaaaggatcatgcctgaagcatctttgcatctcccctaacatctgtttgctaagtgttgaataaaataaaagcttgaaagaatgaatctgactgtcagttgagacatctgataatctaaaagcattcagagaattaggatcccatatggctcgaaaatatttcctatccggcaggaaaaagagaacataccatgaaaataatactgaacattaaatagtaaacaaaaaacaccatgacaagtctaaagagagaccacaaaaggaaggaaaaaggtctcaagttttgatcatcctatgagcccatatatccttcagagcaagacaatgtgaataggcatcgttgcacttggtagagggttaggcaaatagtggatgccaaataaatccttgtggaattgaatggtattacctggagttccctgaaggttgtacatcctcttactccttggcctttggaacgtccttctctatacctggaattcttcctctctctctttacctcctctgactactgtctctttacctcactttgaccttcctagttctgtttatcacttcctctaagagttgttgcttgatgcccctgcactgggttagcagattttgctaagtggtccacagaatcacctacttatgtgtttctctgccagctctataaagacagaccagactaccttgcggtaatttgttcagtattttatccc

SEQ ID NO: 386694 - DNA, 288 bp, Homo sapiens
  misc_feature (6)..(6): n is a, c, g, or t
ggctgnaggaatcgcacgaggtttttttttttcctgttttgagagttagataacatggttaccagaattaacagaaactggtttccccctggcataatgaaaaggagaaaacttagacatgtctgcctttttcttacctcaagggaaattctgcatatatctgcagtcaagactgaatagagagggatcccgcagaagggaaagagctgcatgctatcatactaataaatactcaatggtgagagaattaaatgtcagagctgcaattgcagacagcttttgagaaat

SEQ ID NO: 386695 - DNA, 446 bp, Homo sapiens
tccaggattccttttcttagacattatctattaaagagcaattctaaaatttttcctatatgatctaaagtttctaccaatactctgtctattctttcctttttaaaaaaactaaggaagtttacagaatgttgtttttaaaatattagaaaacacatgtacagttggccctccatatctgcaggtttaatctgcagattcaatcaaccaggaattgaaaatattcatttcaggggagaaaaaaaatacagaaaatgttatattgttgctgacatgtactatgtacctagttaggtctaagatagttgcgtatgtactaaacatgtaccggctttctttttggtcattattccctaaatacagtataacaactatttacagaacacgcattgcattaggtattattaagtaatctagagttgatttaaactatataacagaatgtg

SEQ ID NO: 386696 - DNA, 650 bp, Homo sapiens
gttaataggaaggctttgatttgaggaagagattctgagactccagcaggatgtcttatcaacagtagcaatgtaagcagccctgccagccacctcctgtgtgccgcctgccaaagcgtccagagccatgtccacccctgaagtgccctgagccctgcccaccaccaaagtgtccacagccctgcccacctcagcagtgccagcagaaatatcctctggtgacaccttccccaccctgccagccaaagtgtccacccaagagcaagtaacagcttcggaattcatcaggaccacgaaaggatagggataattggctcacctcgttccacagctccacctgcatcttctcatcaaagccatccagggatacacagggagcttctttccccttagcctgtgatctgcccatgatgatccccgacagcaaaatgtttcctttctgaggctgccatgctgccactgtccaggtggagactgagcaaaggaagtcctcagctgtaccggcctttcagagcttctctttgggtgccatcaaagaattattttgatgtcttctgtctctgtctgtcacctggcatgagcttctactatctgtgcaattgtcacttttctttcactccctgaataaagtagctatgcctataaaaaag

SEQ ID NO: 386697 - DNA, 686 bp, Homo sapiens
agaggttctcagcctcatgactcctaaactcctggtacttgagcaccgatctgcttcggagaacctgattctgagactccagcaggatgtcttatcaacagtagcaatgtaagcagccctgccagccacctcctgtgtgccgcctgccaaagcgtccagagccatgtccacccctgaagtgccctgagccctgcccaccaccaaagtgtccacagccctgcccacctcagcagtgccagcagaaatatcctctggtgacaccttccccaccctgccagccaaagtgtccacccaagagcaagtaacagcttcggaattcatcaggaccacgaaaggatagggataattggctcacctcgttccacagctccacctgcatcttctcatcaaagccatccagggatacacagggagcttctttccccttagcctgtgatctgcccatgatgatccccgacagcaaaatgtttcctttctgaggctgccatgctgccactgtccaggtggagactgagcaaaggaagtcctcagctgtaccggcctttcagagcttctctttgggtgccatcaaagaattattttgatgtcttctgtctctgtctgtcacctggcatgagcttctactatctgtgcaattgtcacttttctttcactccctgaataaagtagctatgcctataaaaaag

SEQ ID NO: 386698 - DNA, 686 bp, Homo sapiens
  misc_feature (44)..(44): n is a, c, g, or t
aaaaatttgctctatactaacatattcggtacacttctagaaanagagaaacttaactatatagcagattctgagactccagcaggatgtcttatcaacagtagcaatgtaagcagccctgccagccacctcctgtgtgccgcctgccaaagcgtccagagccatgtccacccctgaagtgccctgagccctgcccaccaccaaagtgtccacagccctgcccacctcagcagtgccagcagaaatatcctctggtgacaccttccccaccctgccagccaaagtgtccacccaagagcaagtaacagcttcggaattcatcaggaccacgaaaggatagggataattggctcacctcgttccacagctccacctgcatcttctcatcaaagccatccagggatacacagggagcttctttccccttagcctgtgatctgcccatgatgatccccgacagcaaaatgtttcctttctgaggctgccatgctgccactgtccaggtggagactgagcaaaggaagtcctcagctgtaccggcctttcagagcttctctttgggtgccatcaaagaattattttgatgtcttctgtctctgtctgtcacctggcatgagcttctactatctgtgcaattgtcacttttctttcactccctgaataaagtagctatgcctataaaaaag

SEQ ID NO: 386699 - DNA, 359 bp, Homo sapiens
gagtgatacttcagccatccttctaggtgagggtcttgaggccacacagacagaagtggcagagatgggacacacattcgtcttctcactcacagtctggcactgagctgtgggctgctgggacaccatgcccccatacgagtagccttcccactccttaccttgaaggaaaagtgttttttggacaaatacctgatggaaacattacatgggccttggaatctgttagatctagcttcctgaaactcttgctagctgtgtgacaatatacaagtttcttaacctctctgagcctcagtgctctaattacactcccctcatagagtttctaagagcatcctggggctggcacgtgtcaa

SEQ ID NO: 386700 - DNA, 564 bp, Homo sapiens
tgagatggcgtttcactcttgtcgcctaggctggagtgcaatgacgcgatctcagctcactgcagcctccgccttgtgggtgcaagcgattctcctgcctcagcctcccgagtagctgggattacaggcacccgccaccacgcccagttaatttttgtatttttagtacagacggggttttgccatgttggccaggcttgtctcgactcctgacctcaggtgatccgcctgccttggcctctaaaagtgctgggattacaggagtgagccactgcacccagctcagttgcttttttttgcaaacagtttttgtgaatatagatatagaaaaatacataaaatgtatgtgtttggtttaacaaaatattatggagcaaaaacccatgtaatgtaattatcacccagtcaagaaataatggtagcctctcaaaaaatacattagggattcttttttcttttctttttttttttttttttggaagaatattgcatacctattagaaaagtcttttaacaattaaaattggaaaatgactgacaaacttacactatttgatttaaata

SEQ ID NO: 386701 - DNA, 216 bp, Homo sapiens
tctcttcccctgagtgatgagaatgacaaggaccccaatactcccccaggttgtggaggaaactagataacatgggcggaaggacccagtacctggcaccgcctttcagaccctgagctgtagagagggttgaggcttgcacgccacagggccagttgcacaggcagctgccacagcctgcctgacccaggtctcctcacctgcctgccagaaact

SEQ ID NO: 386702 - DNA, 178 bp, Homo sapiens
aggctcaaacgtgggagagaaagatgaacaaaacagccaaaaaatgttggggagggtgcaggtgtcgtccgggtacatttaatgagaaaaatgagtgagactcccgagtaagaatggagttaactagtaatgaaccatgttggcccttagcattcctgctcaagataactgcctagag

SEQ ID NO: 386703 - DNA, 199 bp, Homo sapiens
catggacttggtatgataggaagtaggatgcctttatgggattctagttattagctgtcttctttttgtgcttttatttgacttattacatgacgatctttgattttcttccaatttcatagtcatcatattatcccttaacactgaagagtagttttaacccatatatttcaaaccaatagttattctcagaatgctg

SEQ ID NO: 386704 - DNA, 397 bp, Homo sapiens
cgggtgctgtggctcagtcctgtagtgccagcacatgggaagataaggagggaggatgacttgagcccaggcgtttgaaactagcctgggcaacgtaatgagaccctgtctctaaaaaaagaaaattatccaggtgtggtgcttgcctgtagtcccagctacttggggaaactgaggcaggcagattcccttgagcccaggaggtcaaggctatagtgagccatgattgtgccactgcactgcagcctgggtgacagagtgagaccttgtctcaaaaaaaagaagttaacctacagaatgagagaaaatatttataacccacgtatctgataggggactaatatctaaaatgtataaggaactcataatacatatttgtagcaaaccaagtaaccca

SEQ ID NO: 386705 - DNA, 426 bp, Homo sapiens
tttaagcttaaatttaaataaccacacgtggctagtggccactgtatttgacagtgcagtggtgcaatctcggctgactgcaacctccacctccctggttcaagcaattcttctgcctcagcctcccgagtagctgggactacaggcgcctgcccaagagtgatgaactgtgcatcaggaactcagcatgagtataaacatcaccctcttttttatgcagtttttactcaggttttatttaatgcactgtttcaactttgtagctatcactttagtcaggcacttagattctctgttatgtgagtatttatattgctggactgcaactcagagaaattgatatctgttcttgtcagtggacattttggaaaataagtgcatgaccaatggtggtgattattattacagtatataactaattgaatt

SEQ ID NO: 386706 - DNA, 499 bp, Homo sapiens
ggtcgtcgctgctgaccacgaagctgtcaaaagttcacctccttggctgcccccaacccctgcccctttgccattaaatcatttactagattccaactagaggaatttggctccggggactcgaacctctgaggtcagggtctggggccagtgtgggagagaaaggccttgaatggaaacaaaataaattactttaaggagtttataaaactcacacttatagggagagccgcggggccctgtggtcaatgtaccagcaggcccatgacgcaactgttccgtttggaaatttctggaaagcagtaatttttggaatcataaatcttgagtattttttttttaaactttggaaaggtttttaaactttttttttttaagttttttttaaacttcggaaagttttaagctttggaaagaatgtaacaaaatgttattaacatatgtggagctatcgaatcatttaatggtggtttctgtattttctgttttgttttttatc

SEQ ID NO: 386707 - DNA, 371 bp, Homo sapiens
tggtaccatcacaggtttatgccttatagtcttagctgagctgaacagttattttatgtgtttttggttggctcccagtcctgtttcaccaagcagatattccttgtaccttgctttcaaactggctacaccatggtaactcccctctctgtaagctcatattgaaacatgtccttcatggaaaaatgtatataatacctcttctcactattatccttaccgacttctttgctatctcggtggacatagtgccccatcttctgtgtaaggatactcactctacctatatttgaaattccatctcttcctactttaaggaaccaactctgtcagttaaaccctctttgtcttacattttcaacctattcttt

SEQ ID NO: 386708 - DNA, 445 bp, Homo sapiens
tgggggtctgagatagaaggatcacttgaggctagaagtttgagacagcagtgagccatgattgcaccactgcactacagcctgtgtgacagagcatgatcctgtctccaaaggaagaaaaaaaagataaaacaatagtacttcctgcttggatggagctgcttaaagaaactaccttcatgccttactaggtatgactctctaatttctgcatcaacatgcaatggcatcaaatgctcaattagcaatcctcacagaagtcgtgtctaccgctgttaatcttatcaactacatcagagccaaggtcttttcaagatactctgttaagaaatataagcaagggggccgggcgcagtggctcacgcctctaatcccagcactttgggaggccggagcgggcggatcacctgaggtcaggaattcgagatcagcctcaccaacatgg

SEQ ID NO: 386709 - DNA, 237 bp, Homo sapiens
tggtgtgtggctcagctgcagcggcagcgtagtgggtgtccaggggagtggacaagcaattctcctgtcatttgcaactttcttcaggaactcagataaagaacacttggataacgatgatccctgtagagggatttcatctgtaccatcacacatggaagaggagttgctaggtcaggaaaggcagctgctaagctaaggttcttgtccctttgtccttgcatgcctaaggagggg

SEQ ID NO: 386710 - DNA, 365 bp, Homo sapiens
aataaaaaacaattacctggacttggtcgcacacgcctgtagtcccagctactcaggaggttggggttcgtgaatcacttgagcccagaattcaaagggtgcggtgagctaccattgtgtcactgcactctaatctgggtgataaaacaagaccttgtctctgaaacaacagcaacaataataaacttcagcatccaaatagcctgaaggcttgttaaaatacagatagttggccgggtggtggctcacgcctgtaatcccagcactttaggaggccgaggcaggcagatcatgaggtcaggagatggagaccatcctggctaacacggtgaaaccccgtctctactaaaaatacaaaaaattag

SEQ ID NO: 386711 - DNA, 281 bp, Homo sapiens
ctctggagtgattattttcccatttaaaacaaaaaccaaaaaccttgctacagtattaagtttgaattagggtctgaacgaagttattgtttgctcagacccctcctccgctcttaaacctaaacctccactgccttcatgtaaatgagacaccgtgggggaacagtcctcccttcgggcagccaggcaaccacttggctcacaagagcaatcaagtatctccggcttgaaagttaatagagcactattatttcctaaaagaaaggagaaaatccgcatcc

SEQ ID NO: 386712 - DNA, 377 bp, Homo sapiens
agagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgtt

SEQ ID NO: 386713 - DNA, 255 bp, Homo sapiens
attttgttttgctttcattattaacatacacattctataatacatggggagaaaagcatgaaaatattcactaggataagactgatttccttcatgtctaattttctttttttttttgagacggagtctcactctgtcgccatgtctaattttctgaatacagatgagcctttggatactgatgacaccttagtgggccccagtttacctctactcatttttaattggttcaatcgtgttttatcataaacacct

SEQ ID NO: 386714 - DNA, 342 bp, Homo sapiens
gtgcaggagctgccgcagcttcttccaaaatagagctctcctggctgctgcagctgctgacgtcttcctgcatctctcaacctgctcttcctctcctttcttcccaccacgccatctcccctcgcctgcttcccctcacttggactggggcccgctgggacatcacccagtctaccaccctggtgtctcagagggtgggtgaggtcactgttttccattccaaaccacacctggtgttaggaacattccattttcaactcttcactggtttgcttctgtgggggcagaactcagattttcaagaaaatgcattacattgtaaaaggatctttcagattacaa

SEQ ID NO: 386715 - DNA, 390 bp, Homo sapiens
tgggatcacaggcgtgagccacctcacctggcctgatgtagtttagaataatctttagttgtgtccaatatgtagttttacctagcaaactcgttttaattgttggtacctttttttttttttaacttctctaagttcatctaccttcagattgcatctttggaaggggatgggcagaattttggaaggtagcagttctcttagatgaatagaaaagaggccaggcatggtggctcacgcctgtaacccctgcactttgggaggccaaggcaggtggatcacctgaggtcaggagtttgagaccagcctggccaatatgatgaaaccccgagattgcgccactgcactccagcctgggtgacagagtgagactctttctcagggaaaagg

SEQ ID NO: 386716 - DNA, 1174 bp, Homo sapiens
aaggcagtgccgtaagataaaatgtagttaacagaatagaatgctaattatcccattttgttctgtgtatgttggaaaaaaattacagaactctcagtttcatagtaaagataggtaagtagtgtctggataatgtccagaggatagactgaaactctgtgataaacgtgagcaggcagcaggatgctacctgataactgagtataacagcatgcaggggaggactgtgtggctggaggcagctgcggtagaagttggcagtgccactgtggacttttaaagggacaactctgggtacaagcctgaagtgtaaggaggacataaaattaaatacaattgagcttgtctccttgaaaactggttctctctttttactacattaaaaagatcaagtggacagttaagtcattaattcaggtaattccaatcacaaaactacttttttcctgaagtgtcctaatcattgatttttaaaaatgatatttctttcatcataaattatcagcataattgctttggttccatatttcatattaagcttgggctgagtgatgtttaaagcctcctgcttaccttccccccttttcttcctattttattttacttaatacctaaaaaaaaaaaaagaaaagaaaaaaaaacctcgatgtaaattattttcttctgatactgtgatggtttcatagagtaaaacactttccttagatctcttcatttgaacatttcctgttgataaatcactgaaaacaaaacaaaactacctaatttaaaagcgttgcgatgggtcttccagagtttttatcttacacatagctgttctagggcttcccaccaacatttatttccaaaccaaggacttgtttatctcatccttcatacttttgcatttcagtccgaattggatacgggtttttgttgtctttgtttttgcagtagaaaaacttcagttggtaggatgaaaaggagaacaaatctttattcactttcagtatagttccattaacagtattaatgtgccatgtatgaatatacctgtcatgcagactgaggcccacagactaataacattttgagcaagataattttaagtaaaaactgaagctctgaactcaaacattctttcaaatttctttaaaataataatgatcacttagatgaggtgcatcatttatgt

SEQ ID NO: 386717 - DNA, 339 bp, Homo sapiens
aatgggaagatgaggactggaggtaggtcctagacctaaaaacatcaaaggttcctgcaccggaccgttgatagggatgggaacacaatcatttcccacagtgacatattccaacttgaataacccttaccatcaggaagttccctttgtgtctatcctaaatctttcctgttgaaaactaaaccccatttcctctagttctgccttctgtggagatgaatagctgatgaacactttataagttatatatgaagggtttattataaaccactgcatcagcctttttacccccttgtacaactaaaactttaataaaccagaatgctcaatgaaatatgg

SEQ ID NO: 386718 - DNA, 950 bp, Homo sapiens
ccgtcgtatagacgacatttcaagaataggcgcaatccccggattggcgacatttcaaacatggcgtgatgctgcatcagagagaaaaataagctcttgcattgacaatgaaatgtctacccatgtagatgacttgtgcttacttccactcagcaagtgattgcccagagctacttacctggctccaatctaccactgggtgtgtacttgcaatctaccatgtacctagaagatgagagaaacaaattattaatgatgaccacaccccaatactaacaacaattgcagaagaatcaatgacttaaacaaaaatgtggccattgaaggaatagaaaatatagtgagtttagtgtaaatttaaaagtgattaataagtaacatacaaaatccagaaactataagaaaacagattcacaaatataaatatataaagctttaaaaaagtttaatgtaacaaaaatggcataaaaggagtcaaaagtttttaaaaaatatgttaatgcagtagattaggtgctaattttcttaatatactaataactcaataagagaaattttgtatctagaagaaaatgaacatggaaataggcaattcacagataatggcattcatctggcgaataaaaaatgtgtgacattcagaataaaataaaaatgaatactggtcttcagccatcacttgagcaaaactgcaaagatacaatgagactcaggcattcccatatactgtggatgggagggcaaagaccttcaacctctaattttatttctatttttaaacatgtatgttaaaattttaaatgctaatgtcctcttgacccaataatcttatgtctaagatttgaatctggagataaacttgaacaaatgcatctagatttatgtataagtattaatatagtttagatgtgtgttcccacccaaatctcatattgaaatgtaatccccag

SEQ ID NO: 386719 - DNA, 514 bp, Homo sapiens
ccgtcgtatagacgacatttcaagaataggcgcaatccccggattggcgacatttcaaacatggcgtgatgctgcatcagagagaaaaataagctcttgcattgacaatgaaatgtctacccatgtagatgacttgtgcttacttccactcagcaagtgattgcccagagctacttacctggctccaatctaccactgggtcagacgtttgctgaattcagttctgagcttttgaaccaaaagcagatcttcagaacaagaaacaagataataaaagagaaacatgaagaaactgaagatgattggagaaatatgaatcaagatgattagacctagcagagggctggctggatggcatttatgttgacaatggactcctacacagaggatgatcatggtctaggacataatagtcattcaatcatcatttcttaaatgattttttaaaacaagtgaatgaatgaccaattatataccttccctgagccaataaaatatattaaaagtataggcc

SEQ ID NO: 386720 - DNA, 210 bp, Homo sapiens
catggatatagaggtagattatcttggaaagtcaggcagaatcgctgccttaacaaacataaccacagtgttacagtaaagaaatgttggggctaggtgcggtccctcatgtctgaaaccccagcactctgagagatcaaagtgggagaatcacttgaggtcaggaggtgtagaccagcctgggcaacatagtgagacctcatctctaca

SEQ ID NO: 386721 - DNA, 789 bp, Homo sapiens
cgaggccgacggggacctgacacggtcacgcggcgccggggagcaggttcgagtggccgggcgtggccgtgctgcccctccgcgttccgcaggcggcgacgggcgagcggccctagcgggctgcagggaggacgccgcgtggacggagagccggcgcccgggggccagatcccctcccgggacggggcgccaggtccccgcgagctgcggcgcgacgcgcgggcacccgtgtcccacccggtggcctcgccgctgcgggctgcgctgagagcggggtggcgcgacgcggtccctcaccgcagggggaagacggcaccaccgcgtcccggccgctggaacttcccgcccgcgccgccggcccgacgctgccccctggcgggagagcgctgcaggggccccggcgaggccgcaggacccgacctccccgccggcctcgcactcccgcgccgcctccgagggtcggcagccggatcgccctccgtgccccatagcacccctcacactaaaaacgacgactttattaagatgtgagatacagggtctctgtcgcccaggctggagtgcggtggcacgatctcggctcaccgcagccttgaacttctaggctccagcgatcctcctgcctcagcctcccgagcagctgggaccacaggccccgccaccatgcccggctcagttccatgacttctgacacgcgaaaccaccaggctagtctccccccgagttcaagaagtcctctcctcccaaaagtaccctcctgcccctctgcagctaacccctcacctcccc

SEQ ID NO: 386722 - DNA, 284 bp, Homo sapiens
cccgaactcctgacctcaagtgatacacctcagcctcccaaagtactaggataacaggcatgagccaccatggccagcctatagcaggtaatttagtccagtccttatcagatgcatgagacccctctaaaagatgctatcaagtcataatctttctgattttcttttctggcccaaggtcaggtcatcaggcagtaggttaattacatgaagatgtgttcctgtaccttctcctttgcatttgtactacctcacatctggtactaatacaaataactaaaaca

SEQ ID NO: 386723 - DNA, 401 bp, Homo sapiens
gaatgtacaacatcaagagtgaaccttaatgtaaactatgaactttgggtgattatgatgtgtcaatgtatcttcatcaattgtaacaaatgcactactctgatgagggatgttgatgaagagggaggctatgcacttgtggggggaggggatatatggaaaatcttcctaccttcctttcagttttgctgtgaacctaaaactgctcttaaaagtagtcttttttaaaagaaaaacctggaatataacattattggatgaaacaatcaattatgttaatattgacaattgatttaatagaactgtcttggctctaaaattgtaattttaaatgcatctttgtagaaatgaaactatatcttaaactatatgttcattaaattattttttaaaagacacca

SEQ ID NO: 386724 - DNA, 650 bp, Homo sapiens
gttgtatatatcaaacctcttcattactggagataaaagaaatacaataaatagaagagaaggcccctcctcgtatcttcattctagaagagagatgtttgtagtagcttcacctgttgtcaagctgccatttctttctccactgtaatttcctaaaagcgtggtaggaaagagaatagttgctgagaagggttcttgagcttaatttctacttaattattagatttaataaaggcaagttttaaagaagtatctgtggcctgacaaagacttcaagccaaattagaggcaaaggagctcaaactcattcagagaagaaattgtgttagctgaaaaagaagtcggtgctaatctttaagattttttaaagttctctctagaccaaacaaagaagggaagaaaattttagcatgattatagtttacacacatttattaatggcattatgttgaaaaaaagtatttggcattattgtatagtgaacagggagttagaaagtgggttgttcaatgagaacacatggacacagggaggggaacatcacacaccagggcctgtcgggggtgggggtctaagggagggatagaattaggataaatacctaatgtagatgacgagttgatgggtgcagcaaaccaccatggcacgcg

SEQ ID NO: 386725 - DNA, 187 bp, Homo sapiens
tcccttccagcatcttactacattcttccaggtcaatttcaggaatctttagataaaaagaaacacagtccttcgttactgttcttccagccctcctgtattctgctggttttagagagtgtagaaaagctgttggaactctaattttacattttatgtactataaggatcaaaacaaaaatatctg

SEQ ID NO: 386726 - DNA, 159 bp, Homo sapiens
aaggagccattcagttttctatgaggacttttaagagacatttacccaaggtcttggtatcagaaaagcattctatctcctaaaggacttcttactgaacatggaatttcatgcatccctctttcctctagggccacaagcagcctccaagtcaaattt

SEQ ID NO: 386727 - DNA, 460 bp, Homo sapiens
cctacatgtccatcaactgatgaaacatgggctgcatccatccaacggaatattatccggccataaaaaggaatgacatcgagttgaaggcagggtcttgaggagatatttgcacacccatgttgcatgttcattgcagcatcattcatgagaactgagaggtggaggaaccctgtgcgctgaaattggggctggccgagccaggtaggaggtggacaggctccctggcggctctccagggacgtccttcagggacagcttcgaggacgtcccatgagcagtgcccatgtggtcaagggcttcagtacccggcagcagctctcagccaccttgaccatgagcaaggagaggacatatctggtgcctcaaaagaacatctttgcctaaagctcatctgggagagagagcaagcagactgcaaatttctgaaactgcttgaaccaagtgcatgaatttggtg

SEQ ID NO: 386728 - DNA, 1016 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcga

SEQ ID NO: 386729 - DNA, 690 bp, Homo sapiens
ttgcttgaggatccccccgactagccgacaggtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcga

SEQ ID NO: 386730 - DNA, 1294 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactggaaaaaaaaaaaacgaaaaaaaaaaaaaaaaaaaacccgcgagaggcaccataagggcgggggaggggaaaaagagagggataaggaaaggggcccaggggccaaaagggagtccgggaaccacggtatcagggtaccaagggggcaaaactcggcggggctacccaaataggggagcgccaaataaaagtcgggagataaccgagggtataaccggcattaaggacccgggagag

SEQ ID NO: 386731 - DNA, 963 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcga

SEQ ID NO: 386732 - DNA, 724 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccatctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgga

SEQ ID NO: 386733 - DNA, 680 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccatctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcga

SEQ ID NO: 386734 - DNA, 1060 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgga

SEQ ID NO: 386735 - DNA, 720 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccagtctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcga

SEQ ID NO: 386736 - DNA, 764 bp, Homo sapiens
tcttctcatagtggacccctctctctcgactattctgagccggtttccgtttgtactcctcccctcttttcccgttcgaggtctgccttctcctctccccgtttttcgcgccttcttggtttcggttgtgtgggaggcccctcttccccggtcgctcaaacataccagactagattgggacataggcccgcctcgaagagtccgccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccagtctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgga

SEQ ID NO: 386737 - DNA, 247 bp, Homo sapiens
ctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccac

SEQ ID NO: 386738 - DNA, 230 bp, Homo sapiens
cttcttggacggaggtggtggttcaaatgaaatttcagccttaccctttgtagttttctacgtaataaatcctaacatctgtgattaaggtgacataggtttttttgagaaaggctttgatttcttgcttgcatggatggttaatactccaggctcttcagggtgattctcgccctcttgttctgtagcttgtggtccttatttattttaatataatttaaaacttgcag

SEQ ID NO: 386739 - DNA, 572 bp, Homo sapiens
gggtttcaccatgttggccaggctggtctcgaactcctgacctcaggtgatccacctgcctcagcctcacaaagcgctaggattacaggtgtaagccatcgtgcctggcccaattgtttgaatttttgcatgagtgaaaaatcagaccttggtgatggccttgagcagtagagtatcagggtgagtgataagcactgcctttggagtcagtcggtcctggatttaaccccagatctgtctctaactccagctgcctctctttccccatctgtaaagtaggaatgataaaaccagccccctagttttttaggtgtgtgaggattatggactaataccaacagtaataatcctagctgtatttgtctgttctcatgctgctaataatgacctgaggctgggtaatttataaaagtaagaagtttaatggactcacagtttcacatggtcagggaggcctcaccatcatgatggaaggcaaaggagaagccaaggcacatcttacacggtggcaggccagagcgcctgtgcaaggacactcccctttaaaaacatcagatctcatgagacttact

SEQ ID NO: 386740 - DNA, 560 bp, Homo sapiens
ctgatttcaccctctgtagtgtggactcctgcctgaataccggctttctcccccatcttgcaacctcgggtctcacctccggtccctcctccatactgttgcaagatgggggagaaagccggtattcaggcaggagtccacactacagagggtgaaatcagcatcctcagaggaatttgcaaggaccttgttacagtcaaggcttgcttatgtaccaaaaagaaaaagaaaaaaaaagaagagggaagggagagagaaggaaagagagagggaaagagggagagagaaaaagaaaggaaacctgctcggagaaagttaagcttttttccaataaatcagttgtcaggggctcaggttgctaagctacagggaaagtggaacagcctgtgctcgctaaaaggagctttgggggaggtgagtgtaatcagtcaagttgttccctcctccaggcccagagccccaggcctcaccctgtgcagggtgggagcagagagctgttccacctccaggcagggcccacagggttcaaaccatgcagcaccacagcagggagagaagtt

SEQ ID NO: 386741 - DNA, 339 bp, Homo sapiens
tacatctatatctgtaagcttttgtacagtacttactttagtaataaggcacttgaacacttattattctctttactcataaccaccacaagaagaaaggacagaaattgttattctgtgttacagatgaagaaaaaggagagctaaagggggcaactggcttggccagagacccacacagatagactatggcagaccccgtgtttcccagtggcttgaatttttgtccagagctctttttgtcacactgcaataaagcacaagtcaacaggaaacctttacaaccaggcagagaagcttggatcagggagcaggcagtcacactaaattgtagaaaag

SEQ ID NO: 386742 - DNA, 222 bp, Homo sapiens
tatattaccactgggcatggtggctcacatctgtaatcccagcactttgggagggcaaggtgggcaaattgcaaaaattagccaggcatgctgacatgcctctagtcccagcttttatggaagcagaggtgggagaatcacttgagcccatgaggttgaggctgcagtgagccaagatcgtgccactgcaatccagcctggacaacaatgagaccctgtctc

SEQ ID NO: 386743 - DNA, 726 bp, Homo sapiens
taggttttgctgcatgtgtgtaatcagctctactaggcaagcgcaaattattttccaaagtaactgcaccaatttttgcttcttatcagcagtgctcctgcttgaatcttatcagactttctaaatttgttcaagttaatgggtatgaaatggtatctcattgttttaatttgaatttctctgcttactaatgttaaactcatgctcatgtgttttttggttatctgaattttctcttttgagaaatgcctcttctaatcttcatctactttctgttgtttgtctgtgttctttttttttttttttttttgagacggagtctcgctctgttgcccaggctggagtgcagtggcgtgatctcggctcactgcaagctccgcctcctgggttcatgccattctcctgcctcagcctcccgagtagctgggattataggcgcccaccaccacgtcctgctaattttttgaatttttagtagagacggggtttcaccatgttagccaggatggtctcgatctcctgacctcatgatccaattggtagaagttctttgcaagtcttttgttagttactggtgctccacatatactttcctgggctattggctttatgatatcttttgagaaacaggattttcactttaatgtacaaattattcattttccttaatggtttatactttcatcttgcttaaccaattatggatactcccaaattaaaaaaaaa

SEQ ID NO: 386744 - DNA, 261 bp, Homo sapiens
caaaaccccacaaaagttttccacagttgcagcctccagttcctctgctcccattctcctacatccatgaaaattggtgtttgccaagatcgctgaaggcctccacgctgaaggactcctccagtggtcaactctgcctttaccgtagttaacactgcagcgggatctgaacagtgcttcgcctccgtgtacaactggactcctgcgtgcctgcatgctcacactgcttctccctctccctcctaggcactgctcaggcct

SEQ ID NO: 386745 - DNA, 399 bp, Homo sapiens
cacacacacatatatgatccaatcatatatattggatatatatatgattggactggggggcagttttccccatgctgttctcatgatagtgagggagttctcacaagagctgatggttttaaatgaggcactttctggttctcgctgacactcctgccgccttgttaagaaggtgcctgcttccccttccaccatgattgtaagtttcctgaggcctcctagccatgcttcctgttaaacctgcagaactgtgagtcaattaaacctcgttccttataatgaccctgtctcaggtagtattctttatagcagtgtgagaatggactccactgatgttacataaccaccaaatacattgttttccttatgctttaaactgtcaattatcttttagtggtt

SEQ ID NO: 386746 - DNA, 381 bp, Homo sapiens
ggatgcagggtggggggtctagacctgggggcgaaataagagagggcttgtgctaagtcacgggctgccactaatgccccagtgagcagtggtaaatgctggtgtctgtgttggtgctgtttgctgccatctgaaatatgtatcacacgtcacctgttgctcccattctcttctgcccagtgggtaatgctgcctcatagcacaactcaggatgcagtggacactatgaccccatctgtggggtgtgcaacgcagtggacttccgccggctcatcacccttgacttgggtctcctggcaggaatgattttgaggttttcaaattttgtttttaatttaatttaattttttttgtttgacagagtctctctctgctgctcag

SEQ ID NO: 386747 - DNA, 712 bp, Homo sapiens
taataattatcgagtgctattggcaggcatgggaaagtgctaggtatctcctatcttcctaaatcccctgaagtaaatagtatcccactttacagatgacgaaactgagcattttgtgttttagtaacttcccatagccagtgaggtgtcaggtttcaaaccattcactccattcgttcatactctgcggcttatttcccatgccattttctggcgtctggcccgggttaatcatttccatacctgcttgtgttagtctcctagggttgccataacaaagtactacaaactgggtagcttaaaacaacagaaggactcccacaattctggaagctagaagtctaaaagttcaggtgttggcagaggcactttccctctgaaggttctgggggaagaatctttctttacctctccctggcttctgatggttgtcagcaatctttggcattccctggcaggcagcttcatcactcctccaatttctgctccatcaccacatgatcttctttcttttgtgcctttgtctttacatggccttttttgtcgttgttttttgaggcagagtcttgctccgttgcccaggcagcagtgcagtggcatgatcttggctcactgcatcctctgcctcctgggttctaccaattctcatgccacagcctcctgagtagctgggattacaggtgtgtgtacatggccatgttataaggacact

SEQ ID NO: 386748 - DNA, 347 bp, Homo sapiens
cattttacactgtgagctctagcccaaatgcttttcctttaaagttgtcatcatttaaagatcccagtgttgaattcctttgcatgttagggatttgagtaggtgtattttgacactaaatattttcagtgcttcaaaattgattgcaatactctcttcttcatctagagaaaagctatacctgctgacattacaattgttttagaacttcaacgactttatgtcagtgttgttacattgagaatcttaatcacatcttctgattaccggattgagtttctgcatgtgtatgtgtgtgtgtatctctgattaaaaatgaataaaatgattaatcattcttttgtaac

SEQ ID NO: 386749 - DNA, 330 bp, Homo sapiens
tggggttggcaaaaccgatctgaagtgatgtaaaactatttatagcttcaatttatcccgcttagctgtattattcatgtttcactgcagaaaaattaaggtgcttagtgactatgtgctaccttagacatggctgtattatgttacctatgggttatgtactatgttatcttttacaatctgaaagaggcagggtgtggtgtctcatgcctgtaatcccaacactttgggaggccaggacatgaggatcacctatgtagccaggagtttgagaccagcccgagcaacagagtgagccaattgcttgtgttggccttttactttccatgt

SEQ ID NO: 386750 - DNA, 554 bp, Homo sapiens
gggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaataatttcagtaagaacctgatcaagttgaacatgtatatatatgttatatacaagtttgaaacatatttctgtttttatatgttttcttatgatgcaagggcatactcttatgcaaataattaaaacttcataggtcttaatttcccatatctctatatattattatgacctatccaactggtaaccctatgaacaccttaaaataaacttgtatactcttaaaaaggtgagtttttcttgttaatactattattattgctatctaattgaatacttgaaggaagttgtgtgaaagaccttggctttgattttagttcttatattcttctagtttttgaaaataaaacacttccatcaacccgt

SEQ ID NO: 386751 - DNA, 712 bp, Homo sapiens
tgaaacatcgtaccctttaaccaatattgctctatcctccctaccctctattgttgccttcccttccctccacccacccctggccatctcttggcaaccatcattccactctctacttctgagtttgacttatttaggttctacatataagtggggttatgcactatttgtgtggctgtgcctggcttatttcacttagcaaaatgtcctctagattcatccacaacacgatttccttccttttttttttttttagtttttttatattattatacttcaagttttaaggtacatctgcacattcagcacatgtatcccagaacttaaagtataataaaaataaataaataatttcagtaagaacctgatcaagttgaacatgtatatatatgttatatacaagtttgaaacatatttctgtttttatatgttttcttatgatgcaagggcatactcttatgcaaataattaaaacttcataggtcttaatttcccatatctctatatattattatgacctatccaactggtaaccctatgaacaccttaaaataaacttgtatactcttaaaaaggtgagtttttcttgttaatactattattattgctatctaattgaatacttgaaggaagttgtgtgaaagaccttggctttgattttagttcttatattcttctagtttttgaaaataaaacacttccatcaacccgt

SEQ ID NO: 386752 - DNA, 311 bp, Homo sapiens
taaaatttttcattactgatcataaaagagattggctaattatttttctttcttgggtactgaggttatgttaattttatgaaatgaattggaaagtgtttcctccttttgatcctctggaagaatgtatataagattaaaatgatattttctttgaacgtttggtagaatttgcctgtgaagataatctggacttggtgttctcattttcagaagagtttaaactactgaccactgtctttaatagttgtagaaactttcaggtattctctagcttccttaataatttctgttaaattatatgtttctag

SEQ ID NO: 386753 - DNA, 415 bp, Homo sapiens
tgcaaagcccctcattttggcagaacataccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcaaaaaaaaaaaa

SEQ ID NO: 386754 - DNA, 189 bp, Homo sapiens
  misc_feature (22)..(23): n is a, c, g, or t
  misc_feature (27)..(27): n is a, c, g, or t
tggttgctactactaccgttgnnagangacgacagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcaaaaaaaaaaaa

SEQ ID NO: 386755 - DNA, 403 bp, Homo sapiens
agcaagagccgatctcctcacaagggagtcaagagaggtggcagcaaaagaaaataccatgtcgaccagccgcaaattaaagagtcatggcatgaggaggagcaagagccgatctcctcacaagggagtcaagagaggtggcagcaaaagaaaataccccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcaaaaaaaaaaaa

SEQ ID NO: 386756 - DNA, 346 bp, Homo sapiens
gtgagtgagggatggggaggagattgccaaacttaggcacacattgctgccaggccctccctcttggaggcagctctcacaggaccctgaaatcttggcctgagattatttccaataactaaatgcagatttgagcaacaagagtcttgatgggaatgttctaattcgtgtctctgttgcaaacctgtcctttcccacagccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatg

SEQ ID NO: 386757 - DNA, 442 bp, Homo sapiens
agcaagagccgatctcctcacaagggagtcaagagaggtggcagcaaaagaaaataccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcaaaaaaaaaaaa

SEQ ID NO: 386758 - DNA, 211 bp, Homo sapiens
gtgattagaggatcccatccccggctctgggtatcgatgccatcactcacgccagacaactttgcttaggactgccaaactcttccccacgcaaacttttgccagaagtaatagaatggataacagtactttttataaaactcaggttcaggcctgacatagtggctcacgcctgtaatcccagcgttttgggaggccaaggcggacagat

SEQ ID NO: 386759 - DNA, 407 bp, Homo sapiens
aattacctaacaatggaaagtcattgttctcagaatgagagtccttctcaggcccaggcctgaggctcatggtgtgtgtgtgctctcaggcggaaacatcctcctgattgtcctgttgctgtttattgtggaattgtgtcccacacccacccccttgtgtttgtgttcactaaatgaaggctggaatcctgcctaactttggatgatattgtgcttgtcatagtcatatgagctgaaaacaaaaataaaaagccctccataaaatgtctccccctccctccccctctagcctcacccctagcatgacttgtgagaagtaactcctcgttttacctggcatgatttctaactcaacatacatctccgcctgtgagatcatccgagatgtactgtggaatgctcgtgcc

SEQ ID NO: 386760 - DNA, 607 bp, Homo sapiens
ttttcagaattcttcacaccactggatatattgaatgaaagaatgagtggtgcagagaacccataaatcatgaaatccgagaagttggacacaatgaatacagtgttctatgaagataaatattaataataaaattgttaaaattgaacactttctcaatgcaacctgagaaatagggttagttatggaagagatactctggtgtacctatttttattcaattggtgaaaaagcagatacaaccaaaggcaaaacacttagagtagaaaaagaactgcaacatcactcaaccattccttgctaacaagcagagagtaccagtgtttttcagtttaaagaagtggaaagttttaacagtagaatgataaaattgtaataatataaattatttttcaaatacattaacaaaactaaggattttctgaagtttttgataaagttcaatctcaaagtagattacttgttgagtattatggcactacaggatagaattttagagaacagagtagaaagcagaaaaagagcattcctgaagaaatcgggaaatagaatagccatattcattaagacttattaccacttttttcattggaagacatcagagctt

SEQ ID NO: 386761 - DNA, 424 bp, Homo sapiens
aaccaaccacaatctttggccctttagatccaagcatttctctggaggccactaaataaccaattcaactgatagtctcagttgagttttagtgaccaaaagcagagttagatattttctgcatcaaaaatatattagaaggcatttctttaaaagcttattccataaattcaaatctatgggaaatttcaaacatgaccaaagtggagaaaatagtatactccacaaatagtataatgagcccaatatttaaaaatttccaacctatggccaatcttacttcatctatacctctgtgcattacctactctctccacctcccatccctctatggaattatttaaggcagttttttgaggggtccaatattttacttatctgccaacaaaaagcaaatattaacttgatacagtttgcgtgtttg

SEQ ID NO: 386762 - DNA, 665 bp, Homo sapiens
tatatatcatgatggaaaagaatacataacttttgagacgttgactctaggtcacactaaataaaattcttttattttttaaaataagtctacgtgttttgaatagtaaatactgcaatagcaaataaatggaatagaaaaaaaaaccactagcacaagtgtgcaaatataaatgtgcagaaacaacttacgtaaaatttgtaattaaaacaataaaatctgggctgggcacgctgactcacacctgtaatcccagcactttgggaggctgaggcagggggatcactcaaggccaggagttcgtgaccagccaagccaacatggtgaaaccccgtctctactaaaaatacaaaaattagctgggtgtggtggcgcgcacctgtaatcccagctacttgggaggctgaggtgggagaatcactcgaatctgggaggcagaagttgcagtgagccaagatcatgccattgcactccagcatgggtgacagagaaactctgtctcaaaaaaataaaacaatatctagaaacaaccctaaaatctatcaataggctactatgtaaagtatagtatatccataaaatagaatactctgcagccattaaaatgattgagacaaggacaaagtgtactgacatggaataatgttggagatatactattaaat

SEQ ID NO: 386763 - DNA, 414 bp, Homo sapiens
tgtaaaataggcttgcgtcaggtgattttgccaactgtagggtaatgtggtctgagcacatttaaggtaggccaggctgtgatgtgcagcaggtcaggcatagtaaatgccttctgacttacgatattttcagcttgcgataggttagccaggatgtcagcgcatctgcactcctgcagtgaatgtgcatgctcccccatggccccatgagagtccttcctgggggtactggagcctgtctgttggtcataggggagactaaaagcacatgccagctgtcctctagaatggggccaccagtcctcctgcattgcagcatgagatgggatactcccacccacagtgcgcctctgtgggcgtggtgctgatggggtgacagtggtgatggtggcagagtggggatgcggatggcaa

SEQ ID NO: 386764 - DNA, 541 bp, Homo sapiens
aggagacagagtgtcacagagatctggggacttgagcatcacaggcaagaggcatgctagtgtcgaatgctgctgagacaccaaacgagggaagggtggagaaacttccattggatttaacaaggagaattatcagtgaccttaacaagaacagtttcactgaggttgtgggtggaagaggccaggttgcagcaggttgaggcgtatgtgaaaggtgaagaaaaggaaaccatgagtataaacaacttgttcaagaaatttcactctgaaggaaaaatgagaaatcgcatagtaatcacagaatgtgatagagttgcaggacgttttctgttaacctttttaatgtaaacattgttagaggcttgaacatgtttgaattaatgggaaggagccagtagaaacatcaaagaggagaggatgtaacaactcaatgggccttaagaaagtagcagggaatgggatctgaagcagaagtgcaacagaagcgccgggcgcagtggctcatgcctgtaatcccagcactttgggaggccgaggcagg

SEQ ID NO: 386765 - DNA, 451 bp, Homo sapiens
cttcagcaaccaccaccctgatcagtcaacaaccaacaacatcgaggcaagaccctccatctgcaaaaagattatggaccttgctgaaggcctcagatggatcctctagcaagttttaccttgtaaagtctttttaaaattaagatatgtacattgtttttaaacataatgccagtgcacatttaaaagactccagtatggtataaataaaactcttatatgcactaggaaaccaaaatttcatgtgactattgagttatttgctttattgtggtggtctggaactgaatatctccaagatatacccatacttaaaatgctcagaggaagaagaagttatcaaccaagagttctgaatcagttaaaacattattcagaaatgaaggtgaaataaacacattcccagataaaccaaactgagaagactcagtgctgcagacatgccacacaa

SEQ ID NO: 386766 - DNA, 947 bp, Homo sapiens
ctgacggccaaacgtttcctagacgttgtcgttactgataagaaactacatttcccagaatgcagtgagggtagcgaccgggctacacagtagaaacagggtttcaccatgttggccatgctggtctcgaactccagaactcaagtgatccgtccgcctcggtcttccaaactgctgggattacaggcgtgagccaccgcgcccagcctttggggaagttctttttaccgtccatcatccattgccaccacaccttctgcttacgagttatttataataagtttaactaaaagagaacgagagaacatcccctgaaacccaaagtttgtcattctatacagctttcctgcctgcaaaagaggaggagcagactcatccagcaaatcacctaaaaagtttgaagatcaaaaagcctagctccagtttcagatccttcccctacctttctgaacactagtttcttcctctgaaaaacgaaagagggaacgggaccgtagagtggagtgggcacaagaatcgcaagtcccttctggctatgacgctgcaagactctaggtacagtttaggactccgggcattcagatccccgggacttgtcaagttctcctcattgacatttttgatatttcgtgacaacacaaattcatcacatttttgtgctgtgtgttatatgtgggaaggagattttaaaaagattgccttttgaagttattggatagctgtgttacagaagaaaacattgccttcaagaagttattggatagatatgttacagaagaaaagacgtttgtttcatttttgactttgcaggaaaagaatatgtaacacatcagaattcttctctcctccctggccttagtcgagtacctgaggggcattaaagcacttcctccttgcaatcacttacccagcatagtccttaatacagatatcttcattgttgaatg

SEQ ID NO: 386767 - DNA, 1044 bp, Homo sapiens
ctgacggccaaacgtttcctagacgttgtcgttactgataagaaactacatttcccagaatgcagtgagggtagcgaccgggctacacaggtgatgaaggggggaactgcatcctgggatccgcagtttcgcctgtccacccgccaaatcctaagagtggctgggcgcagttattggggagtggtagtagaaacagggtttcaccatgttggccatgctggtctcgaactccagaactcaagtgatccgtccgcctcggtcttccaaactgctgggattacaggcgtgagccaccgcgcccagcctttggggaagttctttttaccgtccatcatccattgccaccacaccttctgcttacgagttatttataataagtttaactaaaagagaacgagagaacatcccctgaaacccaaagtttgtcattctatacagctttcctgcctgcaaaagaggaggagcagactcatccagcaaatcacctaaaaagtttgaagatcaaaaagcctagctccagtttcagatccttcccctacctttctgaacactagtttcttcctctgaaaaacgaaagagggaacgggaccgtagagtggagtgggcacaagaatcgcaagtcccttctggctatgacgctgcaagactctaggtacagtttaggactccgggcattcagatccccgggacttgtcaagttctcctcattgacatttttgatatttcgtgacaacacaaattcatcacatttttgtgctgtgtgttatatgtgggaaggagattttaaaaagattgccttttgaagttattggatagctgtgttacagaagaaaacattgccttcaagaagttattggatagatatgttacagaagaaaagacgtttgtttcatttttgactttgcaggaaaagaatatgtaacacatcagaattcttctctcctccctggccttagtcgagtacctgaggggcattaaagcacttcctccttgcaatcacttacccagcatagtccttaatacagatatcttcattgttgaatg

SEQ ID NO: 386768 - DNA, 1174 bp, Homo sapiens
  misc_feature (915)..(915): n is a, c, g, or t
  misc_feature (917)..(920): n is a, c, g, or t
ctgacggccaaacgtttcctagacgttgtcgttactgataagaaactacatttcccagaatgcagtgagggtagcgaccgggctacacagtagaaacagggtttcaccatgttggccatgctggtctcgaactccagaactcaagtgatccgtccgcctcggtcttccaaactgctgggattacaggcgtgagccaccgcgcccagcctttggggaagttctttttaccgtccatcatccattgccaccacaccttctgcttacgagttatttataataagtttaactaaaagagaacgagagaacatcccctgaaacccaaagtttgtcattctatacagctttcctgcctgcaaaagaggaggagcagactcatccagcaaatcacctaaaaagtttgaagatcaaaaagcctagctccagtttcagatccttcccctacctttctgaacactagtttcttcctctgaaaaacgaaagagggaacgggaccgtagagtggagtgggcacaagaatcgcaagtcccttctggctatgacgctgcaagactctaggtacagtttaggactccgggcattcagatccccgggacttgtcaagttctcctcattgacatttttgatatttcgtgacaacacaaattcatcacatttttgtgctgtgtgttatatgtgggaaggagattttaaaaagattgccttttgaagttattggatagctgtgttacagaagaaaacattgccttcaagaagttattggatagatatgttacagaagaaaagacgtttgtttcatttttgactttgcaggaaaagaatatgtaacacatcagaattcttctctcctccctggccttagtcgagtacctgaggggcattaaagcacttcctccttgcaaaaaaaaaaaaaaaaanannnnaaaaaaaaaaaaaaaaaaaaaaaaaataaaaaaaaaaaaaaaaaaaaaaaaaaaaaaaaaaaaaaaaaaaaaaaaaaaaccctgggggggggccccggcccccatttccccttttagtgagcgattttccccccctctcttggccgtttttttccaacgttgggatgggaaaacccctggggttccccaattaatttcctttggagaaaatcccctttttgccccttggtttattaccagaaaaggcccctccc

SEQ ID NO: 386769 - DNA, 302 bp, Homo sapiens
tggaagaaatataaaaattaatcattacagtgaaaattattaacacacaattctcagtaattgatggagaagtgagataaaaatgatcagggagagaatatttgaaataaacttgcgatttatatatgatactacatctataaacttctgactatgcatttttatttcacattcacacagaaaatgtagaaagattagtcatatacttctgggccataaagtagtgttagtacatttcaaaagttttaaattcatacagaacattttctgacctcatgggaattaagtcaggaagcactaag

SEQ ID NO: 386770 - DNA, 579 bp, Homo sapiens
tcataatattgtacaaccatcaccactatctatatccagaacttttccatcaccccaaagagaaacttggtacccattaaacaataattccccgtccactcctttccccagtccctggtaatctctaatgtatattgtgtctctatgaatttacttattctagatatttcatatataagtagaagtatgcatttgtcttatgtatctgacttatttcatttaacataatgttttcaaggctcatctgtgttgtatgtatcagatgttattccttttcatggctgaatactattccattgactgcatataccacatttgtttatccattcatctgttgatggacacttgggttgtttccacatttttggctgcagtgaataatgctacagtgaacattggtgtacaagtatctgtttgagttcctcttttcagctcctttgggatatacctaggaattatgtttaactttttgagtagctgagaaatctttaataaatgataacacaaatacttatatttgccaatgcaaatatgaatatttttggcttttaagagattgcggttgagaccacgtggttg

SEQ ID NO: 386771 - DNA, 1540 bp, Homo sapiens
atagaaattcctctagccagcattcgctctccagttccctcaggtcccctccctgctccccattatctaaatttggccatttcccacatttgccattgttttcactgtctggatcctaaaagcatggagtttctgcccctggtggggaggaaagaactgccatcaagggtcaggagagctgggttctagccccaggtctgcatctgattcgtgtgtgacctcagacaacctcttccaatctctgggcctcagtttccccttctgtgcagtgaaaggattacagaaggaggtcagagaccatttggtctccgacagtccaggtttgactgtgttctacttatgtattcaccccacacatgtgccctgctttgggtctggggttgggttgagtggatgctactttttgaattttcacccaccgcattcccaaggagctctggtgtgcacggtgcattgagctctctgtcagaaagtgaacagttctgatttcctgcagccttttcgtactgtgcacacccccgactcaaaaacatacacacagagtcagtgcccaggcatggctgttagggtgaggtcaggctctggcccatctccagatgatggggatctgcttaccactgccctcaacattcaatcccgtttgagcccttctgttttgtagtcttggctgaattgttatttcttccacttgttggcctcagcattccccttgtggccaccaaaggcagaaacaatgctttagagatttttaggtagttatcatagctctcctgtgcagcctactctcctggctgaagaccccaggttccgctgccttgggtggttattgactggcttgggtcatgaactctaggccctacctccctgctcagggtggcactgtggtcaggtgttgggtcatgccagagcccaccctgatttggcatttggccctagccctcctcttctagccctggagctgggaccttcctcccagctcctctccctaaactgtggggtctgccttctgcggccagcctgactgggatgttccactggcacagagaagctcccagtgtctctggctcatgtatacacaattctgaccctgggaagaaaacagtgggatcccaggctgagccttaactttcagcttgatgactgggagcttggatgtccctagggagtctctaagggtcactccagcattagtatcccatgaaaaatgtcctgctcaggctgttgtataacattcttctttaggttaaagggctccagtttggagtctgggctcatctagcagctgctacattctgtttggataaaacatacaattggtgtctatttcctttggattgggaggaattagaagactctcagttggatgagaggatgactggcttggttatggctgatcactgattggatgaaagaataaatctttggatggttctagattttgatcgggtaggaagcatggaatggactggctagctctgaactctggtggatgactgctagtgaatttggattggattaaatggcaaggtggactggttat

SEQ ID NO: 386772 - DNA, 588 bp, Homo sapiens
aaaaattaaaaattagctgggtatggtagtgtatgcctgtggtcccagctacttgggaggctgaggtgagaggattgcttgagcccgggaggtcgaggcggcagtgagctgtgatcatgtcactgccctccatcttgggcaacagagagagaccttgtctcgaagagaaaaataaaagaaagaaaatgttaatttctgctcctgtcagattagagggaaattcaatctcagtctttttgctgctctccaaagatcccagagttgtacataggattgaagcataaggaacatccttaaagtcagtagcaactggcctgtactaattattcccaggatacgcatatccctttgtggcagcagttctgccagaggcacaggggctttgcccagtcagtctccttcaacttgccacgtagctttctccagaataagtccaccccctcagggtgctaccgtgaaggagagtatggttttggcatttgagagcccagagagatatacatgaagatctggtctctggagagtattgaaggtagaaaagacaaggagaagatgctgcagaacacccagaagggaagaaaaaaaaaa

SEQ ID NO: 386773 - DNA, 377 bp, Homo sapiens
gatggagacaagccaatgaaggaagcagcaaccaaaaggtgcctgaatttgacatccttggacaagccaactgataaataggagagcaaattttaggtagcttcagaggtatgccttattacagaaagtagaagttaatactttgttaaaaataattcatgttgcttagcaacaattatagcaagcttggctctcatgattaaaaaggttttgattcctcttaaaaatggactagcaccataagaactggacacctggagaaacatgaggaaagtctcttcggaagcagctagtatctctcgtatctactttcagcaaaaaattagtaagaatcaagagatcagaaactggatcacagtccttcaatacaaaaaaaa

SEQ ID NO: 386774 - DNA, 447 bp, Homo sapiens
agacacacatgcatatacatgcacagagatgcacacatatacacacagacatgcacacacacatgctacagcatgtgcacacagacacacacaccctgcacaccccaagcctcgtctgctgtctctgctgtgcctgcttcccttagcccctgataccaccttccccaggtctcccaactgccctgcctggacacagagaggggtcctgtgaagtcaggccttgaaggagtgggcgtctctcagcccctctggaagcctcgcaccaggactgtcccctctcccgcagagcattcaggaccagcagccctcagccctgcagtctccagacctggttctggggagcttggggagctggggaggtgggtcaggacccagacacctttgattgggacccatttgacatgagacagtgagtgtcatccctaaattaaatcttgatttcagaaa

SEQ ID NO: 386775 - DNA, 1700 bp, Homo sapiens
tggaacaactcgaggctttacacccattcttttcccacatttattttttctatcagaattcttaaatctaagaaacaaataatatggaggttctttatattaacacattgctttaaattaggaagaaaactgtgtataggctgcagcagactttaaaagcattgtaagactttagatttggaaatcaactttaataacatggaaactttagatttaagagatcatttaatacagctactttgatttggcttttaagagaactgaggcccaggtagcccagaccaaggatcttttgcaaggtcgtgctactgggttctttagcgtcaagactgtaacctacatctttaggttcctaaatttttatcatgccttcttgttacctaactgttgattgttgaactttcttttttcttttttgagacagggtcttgctctgttgcacaggctggagtgcagtggcgcagtcatggctcactgcagcctgaaacttgagctcaagcaatcctcccatgtcagcctctcaagtagctgggactactggcatgtgccatcacacctggataatttttaaaaattatttgtagacacagggtctccctgtgttcgtgtgggctggtctcaaactactgggctcaagctgtcctcctgcctcagcctcacaaagtgctgggatttgaattttcttaaacctaaatcaatattataggcctcaccttaggagaactttccaaaatattgttagtgttgaccaccttagcattacatttgctaacgacagtcatccaggtttactgaaccaggaaaccaactttcaggttaataagacagtttcgtctatgtgccatccttatccttgtctggacatatccatagagcacgcattttaaatctgaaagaatatatgtagtctcccctaccccagctttttttaagtagcaagggctattgaaaaaaatcagaaccctccgcttacgctcgcatacatgtagcttaaaatatatgttgcttattgaaagcattgtttaagttgaactcacgagatatactacatcatgtaatatgtctgcatttgtccatgcattcttttcggaaacctgatcttacttatgtctgcatttaacagataggctaggttaagttatgttaaaacatgttgtactgaggttggattcaccgtgtcacagcctggctttcttccttgattagctttaatcaaactctctgcattccgtgaccttaataaagctatttttcctgacaactgaagactgtcttaacaagcatagttcatctgtgctgaaactaaggctgagttaagatggggtttaggtcctcattaaagtccacagcatggagtgtaagaagaaatgatgaaatggtgctccctgaaacatctcttctttaaatttaattagacaaattatacgcaaactagtagatgccctgggaaggcaatcaacattagggctaataaaaagcttgagtagtataaaaaggctgggggaggtgctgtggagcctttctaacgcctatgagaggcaaattaaaaccaattgcgaaacatggaaactggatgaatttcaatattgatttagaaattaattttattatgttgttctaaatataaaaataaaggctatacttattaatcttccagaatttggcatgttaacacctatgcacaaagcattttatggatc

SEQ ID NO: 386776 - DNA, 1663 bp, Homo sapiens
  misc_feature (4)..(6): n is a, c, g, or t
  misc_feature (690)..(690): n is a, c, g, or t
gggnnnaaggtgtaagaggaggaccttgtagagagccagcgcttagccccagcctcctcatatgcacatggctctgtagaggttctccagacagtgctgctgctgctgctgtttcgagccttatctcctctgtgctcctcacaagtgtcgttaacagcgggcagctcctggcagcacaagggacagggatttgtcttgcttagccggggcaaaatgcagttagaatggaaaagctaatggcaaggcatcccaacaacagcctcctcctcctcaagcacatggggcacttgtgtgtgtctctcagcctgagagctcctgatgactctcctggggaggttcccaaccacactgtcttggcagctggtggaggcaggtggtgattccaatttactgccatccccgagtcttcaaaatccatcctattgaaaagtgatctggtgagctccagcagcatgtgggttagggtctcctgcttggggttcaagagcttgcagtcctgttcattgaaataggctgtcatggctgctcagctctctgacatatctctcagactggcaaagatattaggtctgataccaaaagtacaatccatagaagaaaaaggatggatacattggacttcattaaaattaagaatgttttctccttgaaaaataatgttaagagaataagaagataagccacaaactnggaaaaaaagtaattgtaaattacatatctgataaagtacttgtacccaaaatatgcacaagaatctcaaaactcaataataagaaaacaatccaatttaagaaattattttaacatacattttacaaaagaggatatatagatagcaaataagcccacaaaaagatattgaatattattgaccattgggaaaatgcaaattaaaacaaaatgagataccattacacacctattagaatgtctaatattgagaagactaatcatactaactgatgaggatttggagcaactggaactctcaaaccctgctgatagataaatgcacaaccactttggaacagtttggcagttttttaaaaagttaaacatacatctgccttatgccccagccatacaatttttagacatttctcaaggaaaatgaaagcatatgttcattcagagatacacatgcatattcattgcagctttatttgtaacagccaaaaactggaaacagcccaaatgtccagcaacaaaagaatggataaacaaattgtggtatatttactacctagcagttgaaagaaataaacctctgacacacacaagctggattaaaaaagaagaggaaatgaattattgatacatataataaagattactctcaaaataattatggtaagtcaaagaagtcagaccatgctccctaagagtatatacttcatgattcaatttctgtacaattctataaaatgcaaattaatatatgataacaaaaagtgattgcctggaaatggtgagaggacagaggggccagaatcagccaggattacaaagatgcacaaggaaacttttgagggtggtggatatcttgagtgtggtgatagttttacagttgtatgcctatgttagaagctatcaaattgtacactttaagtatgtacactttgttgtatattaattatgccttaataaagttattataaaaagt

SEQ ID NO: 386777 - DNA, 1711 bp, Homo sapiens
  misc_feature (4)..(6): n is a, c, g, or t
  misc_feature (690)..(690): n is a, c, g, or t
gggnnnaaggtgtaagaggaggaccttgtagagagccagcgcttagccccagcctcctcatatgcacatggctctgtagaggttctccagacagtgctgctgctgctgctgtttcgagccttatctcctctgtgctcctcacaagtgtcgttaacagcgggcagctcctggcagcacaagggacagggatttgtcttgcttagccggggcaaaatgcagttagaatggaaaagctaatggcaaggcatcccaacaacagcctcctcctcctcaagcacatggggcacttgtgtgtgtctctcagcctgagagctcctgatgactctcctggggaggttcccaaccacactgtcttggcagctggtggaggcaggtggtgattccaatttactgccatccccgagtcttcaaaatccatcctattgaaaagtgatctggtgagctccagcagcatgtgggttagggtctcctgcttggggttcaagagcttgcagtcctgttcattgaaataggctgtcatggctgctcagctctctgacatatctctcagactggcaaagatattaggtctgataccaaaagtacaatccatagaagaaaaaggatggatacattggacttcattaaaattaagaatgttttctccttgaaaaataatgttaagagaataagaagataagccacaaactnggaaaaaaagtaattgtaaattacatatctgataaagtacttgtacccaaaatatgcacaagaatctcaaaactcaataataagaaaacaatccaatttaagaaattattttaacatacattttacaaaagaggatatatagatagcaaataagcccacaaaaagatattgaatattattgaccattgggaaaatgcaaattaaaacaaaatgagataccattacacacctattagaatgtctaatattgagaagactaatcatactaactgatgaggatttggagcaactggaactctcaaaccctgctgatagataaatgcacaaccactttggaacagtttggcagttttttaaaaagttaaacatacatctgccttatgccccagccatacaatttttagacatttctcaaggaaaatgaaagcatatgttcattcagagatacacatgcatattcattgcagctttatttgtaacagccaaaaactggaaacagcccaaatgtccagcaacaaaagaatggataaacaaattgtggtatatttactacctagcagttgaaagaaataaacctctgacacacacaagctggattaaaaaagaagaggaaatgaattattgatacatataataaagattactctcaaaataattatggtaagtcaaagaagtcagaccatgctccctaagagtatatacttcatgattcaatttctgtacaattctataaaatgcaaattaatatatgataacaaaaagtgattgcctggaaatggtgagaggacagaggggccagaatcagccaggattacaaagatgcacaaggaaacttttgagggtggtggatatcttgagtgtggtgatagttttacagttgtatgcctatgttagaagctatcaaattgtacactttaagtatgtacactttgttgtatattaattatgccttaataaagttattataaaaagtagttccaggcaatactagacactcaataaacatttgtaaactagtcgt

SEQ ID NO: 386778 - DNA, 383 bp, Homo sapiens
ctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgaggcaaagtacagttttactaatggcatctgaagttgccagatccctcttcattccctcccatcttgcttgttctgtcagtc

SEQ ID NO: 386779 - DNA, 336 bp, Homo sapiens
actttttgtatttttagtagatatgggatttcaccatgttggccaggctggtcttgaactcctgacctcagtttatctttccacctcagcctcccaaagtgccgaaattacggttgtgagcctctgcacccggccgttctgttgctttcctttttaaaattcactttctcctctcaatcatagttggcttaaattcgactttcaaatagggaaaaagcataccgatattctgccactttttttcaatgtggtgttctatataaaagagaaaactcgtagtatgtaaaatttcactatattcctttgaatcatgagctaacataacatctatgtaac

SEQ ID NO: 386780 - DNA, 339 bp, Homo sapiens
ggtcaaaaccagactgttcagcattgtagagcctgccttctgttcattctttcaccagtgcctaggactgtgccgtaaatgagctttgacattcgcgctcattttgatacaaagacactaagtagtttataatagcttgcattatatttatctctagtctttcttcttctcttcttcttctccttctccttctccttcttcttcttcttttttttttttttttttttagatataaggtctcactatgttgtccagtctagagtgcagtggctacagcctcgaactcctgggctcaagagatcctcccatctccacctcccaagtagctgcgactacagg

SEQ ID NO: 386781 - DNA, 477 bp, Homo sapiens
ttcctagttaaactgcaaaatacattttcaaccatttagccataacaacttctaaacggagaaagttgcttctttatataaaccacctctgtttaccaaacatcagagaatctccgggcagagggctactgcaggatgggaatagtaagagaatgttacaacccatgaggtgctgatctgcacacaccaccgtgaggaaataccttaagtgattaaagacaaacgccacctgcatgcttggcaaaggagtccactgctatcgccacacactctccccagtgagagaggggaaacgatggactgaagtcccacagtggattagaactgggcacaaaaggagccaggaacagaagatggcagcataggaagggaatgttatgctttgcccagctggggactctggcagtattatcacttaggcatcctgaagcccaaactcaagaataaagaattaaaatttcatatcttctttgaaaa

SEQ ID NO: 386782 - DNA, 436 bp, Homo sapiens
gaaaagtaaaaatggttttaaaaaccaagttttctaagaaaagcataaatgactaatgataatatgacaattgactaaagctgtccttactgtttgaaagaacaacaaccaaaatatgtatattatacctgtaagttattaaatctgaaactatgatattatgaaatagggtaggtggaaatacgagcaaaatcattaactttcatagtctgcctaagctgaattttgctcccttctcctgtctttccaaggatggcaaagtgattttagactttgtcaattttggtggttagtaatttttgtgagtgatgcatggggaaggagatgctatggtagattacattagtgtctaattcttgtgatgatgcaaagtgagatacattttctgtctttggtggtgtgagaaccctatctactggtagataacttacttata

SEQ ID NO: 386783 - DNA, 569 bp, Homo sapiens
atacctgttcatagttgaatctgttacaaattgttaccttttatttgatgaagaactatttaaagattttccttttttatttcttctaaagcaaaagtcaatgcaagtaactctaatcagcgtgcaaaggcgtgcatatatatctgctatgtaattatataatgtttttataatgctgtgtggataacttttcactgatttagttacttgactgtaggaaacactgttgctttgcacgctgtgagaggtttgcactgttacagatgaaggcaacatatttacatatgtacatgtatatacatatatatatattcaaaaataacatcggctctttggggtgtctgtttccttggttgtctcacgccactggaacattgaacccagacagaccctaggatgtgaggttcctgactgcaccttacggaccacagagccacgtgtctatttctgtagacctatctccttagatttgtacatgcattttttgcggacttgaactttgttttctgaaattagatgccatttatgatgatgtgatgtcaatcaaataaagcatcattattttcaga

SEQ ID NO: 386784 - DNA, 362 bp, Homo sapiens
aatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagag

SEQ ID NO: 386785 - DNA, 170 bp, Homo sapiens
ccaattggtaagtgtccctgggagccgcagccaggcagtctgacctcagactcctgacacctgcaggctgtgccgcatccctgacttgggtgctggccttctccttctaggtactgtccctggcaggcaagtctgaggcctgagccagtcttactttttattgttttcac

SEQ ID NO: 386786 - DNA, 121 bp, Homo sapiens
tgctctccatggagatgaggctgacagggtcagcggagtagcctgtgacaggcaggttttaataagttcattttcagccaacccctgaaatgggttatttttgttccatgggaatgctcta

SEQ ID NO: 386787 - DNA, 648 bp, Homo sapiens
atataagctaacagcatttatactttattttcagaataccagtggttttcttagctctggaagaactatatctttagatcccaatgtagacttaaattaaataaatccgtttggctggcttcatctggatacaaatgactacatatttgtaataggtacttgatttcatgtttaacttacttttctgtttttcctctgtattttgttttcagagcattgagttagcaatcagaagaactaatgtttattctcttccaaatccccttcttgctttcttacttattaagcattgtctgtgtgatttgcttaggatacaaaaaatgatcacaatgtggttttggcttaggaggggctcatgtgaagtggtccatgacctgtctgccttattgctttgttgatgggtttgatagaaggttaagtgtgaaatgctgtgtagacagctcattgttacacaacatctgtattattagcatcctttttaatgagatagatggaggtgtgggctatgaatgagattcttcatggcgtgagttttctggcgggattttttaagagtgagaagaggtgtgccttgaagcaggtaagtaggagaacctactccagatattgagagggatggctagagaaggactgaatagaccagctgca

SEQ ID NO: 386788 - DNA, 787 bp, Homo sapiens
atataagctaacagcatttatactttattttcagaataccagtggttttcttagctctggaagaactatatctttagatcccaatgtagacttaaattaaataaatccgtttggctggcttcatctggatacaaatgactacatatttgtaataggtacttgatttcatgtttaacttacttttctgtttttcctctgtattttgttttcagagcattgagttagcaatcagaagaactaatgtttattctcttccaaatccccttcttgctttcttacttattaagcattgtctgtgtgatttgcttaggatacaaaaaatgatcacaatgtggttttggcttaggaggggctcatgtgaagtggtccatgacctgtctgccttattgctttgttgatgggtttgatagaaggttaagtgtgaaatgctgtgtagacagctcattgttacacaacatctgtattattagcatcctttttaatgagatagatggaggtgtgggctatgaatgagattcttcatggcgtgagttttctggcgggattttttaagagtgagaagaggtgtgccttgaagcaggtaagtaggagaacctactccagatattgagagggatggctagagaaggactgaatagaccagctgcaaaaaaaaaaaaaaaaaaaaaaaaaagccagggcagaggaaggaggtgaatgccaggtatctttctgatgactgtactgtgtattttctaatattctttgaaaactttgagatcagcagagatgctgagccctgctgatg

SEQ ID NO: 386789 - DNA, 166 bp, Homo sapiens
aggtgttggcagggttgttccccttccaaaatctttagaggaggatttttccttgcctcctccagcttctgataaccccaggtgttctttagcatgtgacagtataactcagtatcttcctctgtcttcacatggtcatcttccatgtgtgtttctgtatctaaat

SEQ ID NO: 386790 - DNA, 1009 bp, Homo sapiens
agttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaataggtacagttatttgtcacccctgcaaatacagcaaatacctatccctaaattggctgctccaaactgtcttcttgttacttgggtgaccaatagacagaagcacctacgttttataaaggaagaactttatccctcttggtctgtggaggtagttgctgagtggcactgggtaaaaataaccaattcaggagaatttgtgttcccattagattctccacacaaaaagccctacgaaggtcttatactggggagggttcaagaaaaaactgctctaccattgaggaatgcagatgtaaacgtgctccccattccagaccacaaattaattgtcagcgtgccctgtactcttcactcacataagccaccgcttgctgaggttttaaaagactacatcaagccagatggggaatatttggagttgtttgctcgaaatttacagccaggttggactagttggggcaatgaagttctcaaatttcagcatgtggattattttattgctctggagtctggaagctgactatgatcttgattaaagtagtggtctcttcattgtctcctcaccacttttcccttaattctaagtcattttattatttt

SEQ ID NO: 386791 - DNA, 494 bp, Homo sapiens
agttgatccaggaaggtctcaaaagtggttttctttatccactttttgaaaaacaggacaagggtagtaagcccattactttaccacttgacgcctgcagtttgtcagaattatgtgaaatggcaaagcatttgccttctctgaatgaaatggaacatcagacattacaattggtggaagaggatacatctgttacagaacaggatttatttttgcgagttgttgaaaacaactctagctttacaaaagtgattactttaatgggacagaaatacctgctaccaccgaaaagcagttttcttttatctgacatttcttgtatgcaaccacttctaaactataggaaaacatttgatgtaattgtgatagatccaccatggcagaacaaatcagttaaaagaagtaatagatggagtctcactccgttaccaggccgagattgcgccactgcagtccgcagtccggcctgggcgacagagcgagactccgtctca

SEQ ID NO: 386792 - DNA, 391 bp, Homo sapiens
attaagggcccacaataagactaaaacacatattttcagacttacagagtagcctggctttccctagacaaaacccagacttacctctcaaatcgaggcgaatctacagaggccagagtgaaagtcgcatggccactgccttatgtgtcacctccccaacaactgctaacatcggggtcactggtagaagagcatctatgattactttcaggtcaatgcctcagaggttgagaaacaagtcactacaaagctgtttcatcagcatcttacagatagcttttcattagcggtgagaaatggttactgaagactatatgtgaaccagattgaatacaataatagttcacttatccaggccatcaataaagacagtataggccaaaagttcctt

SEQ ID NO: 386793 - DNA, 306 bp, Homo sapiens
  misc_feature (1)..(2): n is a, c, g, or t
  misc_feature (98)..(98): n is a, c, g, or t
  misc_feature (124)..(124): n is a, c, g, or t
  misc_feature (154)..(154): n is a, c, g, or t
  misc_feature (191)..(191): n is a, c, g, or t
  misc_feature (305)..(305): n is a, c, g, or t
nnattccaagatgcatcccaagcacctaaagcactgcctggcacatatggacatataataagtaagtgtttgttgaatgaataagtgatgggcatttnggtcatttccagcttttcattttttnaacaatgcttaaaagaatatttttgcaaangaacagctttgcttgtcctaatgtgtttgtttccttnctattcaaagtattatccaaaagaataactagacataaattttaccattgagagaaaggtttatacactgaagacaaaacattcctgaaataaataaatacatgaaaaatacant

SEQ ID NO: 386794 - DNA, 298 bp, Homo sapiens
cgtgtggagttttgcttggtcaactggagaaacaacttttgattgtttttatgtttttcagagatttatttgccagagatattacattataataaaaacataaacacagaagttagggattggaacaaaggttatatggtcacaatttaactcatagttatttgaaaattattggtttataaggaaacagatttagacaaagctagaacttatgcaggtaagttacaaagctagaacttactcaggcagttgctcacgtctgtaattctagcactttgggaggccggggcgggcggat

SEQ ID NO: 386795 - DNA, 151 bp, Homo sapiens
ggttgccttataacatgtataacagtactctttatttgtagatacctttgtatgtatgtgtgtgtatagacagatagacagactttttttttgagacagggtatctgtcacccaggctggagagcaggggtatgatcatggctcactgcaa

SEQ ID NO: 386796 - DNA, 654 bp, Homo sapiens
catatatatattccttttatatattaatggttagtagcattttttattttaacccctcacctttcattgttgtagactttattaaaggctgaagagtttgcataaatattagggaagtggacattttctgggtttacagtttacacttttgctgctgttcctttatgaagatgaagcaggtccctccctccctccctttctctcccctgagtggctgaattctacacatctctctagtccctctgaagccccacctctggagcgctgcctctgatcaccccagcccacagtgatctgagttcacagagcacatcctgtttgaatgccccatttgaatcacagcctattcctctttttgagtgttggttgtgccttaagtgcacagatggcttttcaccagctggacctcgagcagcctgaggatgccaccctgccttctgagccattcttccatcacactgtagtgccacagcgctcatttagtaggattttggtaaacatgggtcaactaagtgagacactggcagagcaaggttatatttagtgctagaaaggacctacaacatggtgacttcctcctagtctagagaatgtaggccctgacgctttgatattcccaatgtcgacgcggccgcgaatttagtagtagtagta

SEQ ID NO: 386797 - DNA, 344 bp, Homo sapiens
gacggagtttccctcttgttgcccaggctggggtgcaatggcgcgatctcggctcactgcaacctctgcttcccaggttcaagcaattatcctgcctcagcctcccgagtagctgggattataggcatccactaccatgcctggctaattctgtatttttagtagagacagtgtttcaccatgttggtcaggctggtcttgaactcctgacctcaaatgatccacctgcctcagcctcccaaagtgctgggattacaggcatgaatcaccacacctggcctaaaccaagtattattaattccaaataaaaccaatacatcagaccagtctgggtattatttgga

SEQ ID NO: 386798 - DNA, 1603 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaacctttaaaatattgtaactgataatttccataaaaaccatttacatagtttcaacctttctgcataaaactgtattatgagataggcaaacaatctcacaagatggtctgagacataaaaa

SEQ ID NO: 386799 - DNA, 1292 bp, Homo sapiens
tctggggctgccccaaagggcagacaggtttattgggcagcagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaa

SEQ ID NO: 386800 - DNA, 169 bp, Homo sapiens
gcggccgcctactactactactactgctcgaattcaagcttctaacgatgtacggggacatgccagtagaagttattactttggtcattattggaatatttatatcttagctggctgaccttgcacttgtcaaaaatgtaaagctgaaaataaaaccagggtttctatt

SEQ ID NO: 386801 - DNA, 1521 bp, Homo sapiens
  misc_feature (1509)..(1511): n is a, c, g, or t
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaaaaaaaaaaaaaaaaaaaaaaaaaannnggggggggcg

SEQ ID NO: 386802 - DNA, 1502 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaaatttaactttatttacaaatgttctcctataaacaaagatgccatgtcgacgcggccgcgaatttagtagtagta

SEQ ID NO: 386803 - DNA, 1465 bp, Homo sapiens
ggcactcatcagctcgcacccaccgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaa

SEQ ID NO: 386804 - DNA, 817 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttagtgattactgtgcattattgtctattgtcttagctatttt

SEQ ID NO: 386805 - DNA, 492 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatt

SEQ ID NO: 386806 - DNA, 564 bp, Homo sapiens
  misc_feature (561)..(561): n is a, c, g, or t
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctattcttaaaaaaaaatgagcaagttatgtatgcgcgcgcaattcgagtcacttgggccattcgccctatagnggg

SEQ ID NO: 386807 - DNA, 1482 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaa

SEQ ID NO: 386808 - DNA, 486 bp, Homo sapiens
  misc_feature (2)..(2): n is a, c, g, or t
gnccgctctagagtatccccacagcataaactatcgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatt

SEQ ID NO: 386809 - DNA, 1507 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacataaaatgataaataggtaatttgaataattttattttaagctccttggttaattattttgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaaaagcacttgtttttgtaccttagta

SEQ ID NO: 386810 - DNA, 1425 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcacttctcagggatgaaattctttttcaaagttttgaagttccttgcaacttagccatgatgtgagtggttatccctagataaaattaaaaggatttttaaaaagtaattactgcacattgtctattgtctcagctataaattcaaatttatacatactattgagtattaatattctctgatttcagggagaattctgtcagtcacatgatgattatgtttttgtttaacattctttccatgcacttgttattttattaatttgcctgaatgatgagaccagaccagtgtctacagattttcattgtcagaaaaatctataagtctgccctttttacaatgatgatttaaaaaaaacaacagcgtaaatattagcccacaagagcagtcctaaacaatcacaattacactgtactacccaagaagactgtttattgtgaagcatttacctttcaaaaaatcattacatttctatttcttggtggagcagcacattgtggagtgtgattcttaattcttcattgagtttgtcaataggacattgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagtcaa

SEQ ID NO: 386811 - DNA, 760 bp, Homo sapiens
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctatttatctgtttttttttttaatgttgcacttgtagtttcattacaaaagatcagatcatgaaaggcagtaactctccaggactggaatatctgattgctcagtgttaatagtagttcatgctgtggtgagattgttaaaagggtgcaagactgttgcttctctttttttagatatttttctatctctcatctctcggagtagaatacttttcaagatttggatcctgcaactgactagtagtggatgttactgataaataagattaagta

SEQ ID NO: 386812 - DNA, 557 bp, Homo sapiens
  misc_feature (545)..(547): n is a, c, g, or t
catcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacattggctggggaacagaccagggaattggtggatttggagaagagccgggaattaaatcacagctaatgaaccttattcgatctgtaagaaccgtgatgagagtgccattgataatagtaaactcaattgcaattgtgttacttttattatttggatgaatatcagtggagaaaatggagactcagaagaggacatgccagtagaagttattactttggtcattattggaatatttatatcttagctggctgaccttgcacttgtcaaaaatgtaaagctgaaaataaaaccagggtttctattaaaaaaaaaaaaaaaaaaaaaaaaaaaaaaaaaaaaaaaaaaaaaaaaaaaannnggggggggcg

SEQ ID NO: 386813 - DNA, 1835 bp, Homo sapiens
  misc_feature (1272)..(1272): n is a, c, g, or t
aaaaaaaaatggaaaaagagaaaaaagtaaaaagtaggtaagaaaaaatgaagaaattaggaagtatgtgtttgtatacagcctgccactaccgattatatttaatattcaaatgtgtaccttttaaaaatcaaagttcaaacttacagggtacttagagatttaaaagggaacaagtcatcagttcctatctcaaaactggcccatttacccttctttcctctttctcatttctgatcctggaaacaaaattattttctcatacaacatcgagagcattgcagacaatgtattatagtgagcaagtatgtgcggtagaggcagattctgagtttaaatcctgattctgctagtagttgttgactttggacaaattattaaccactaaggtttccgtcattcatctgtaaaatgaggataataacacttttcctgtaggagtattttttaaaacaacatgtaaaaagtatgtattgtagtgccagcgcataaaagtaatttgttaaaatcgtttcctccttttgtctgccctttcttttccaatcctactgctataacatgaattcggggatttatcgtcttgtatctactagacaccatggcagccttcataccaattgctaacttcccttctccattccattccaagcacttctattcaatatgtttcctttaatccagattttcatcagttttgaagcacatcataatcctttaaaaattcctcaggccaggcacaatggcagatttctataatcccagcactttgggaggccaaggtaggggatcacttgagcccaggagtttaagaacagcctgggcaacacagcaagaccctgcctctacaaaaacatttagaagaatttttttttaatagccgggtgtggtggctgtatgcctgtagttccagctactcaggaggctgaggaagaaggattgcttgagcccagaagttggaggctgtagtgagctatgatcatgacactgcattccggcctggatgacagagtgagaccatgtctttaaaaaaagaaaagtttctcaccatccatagataattaaacatttccaggccgactgaattcctccacggagaagacaggagagggattcagaaccaacctgagcccagggctgctccactccctgctctctaccttcttccccttgggtttgagcccagattttaggtgagatgagctttcagctggtggaacatctctcttccgttttgctgtgataacaactctagttcttatgtggagggagggnttaaagtgcattggagtgcactatccctccacagaagtgcttcaccctgcagcgcaaatgtgcttcctcctgggttgggcatctagcccaggtatttctgagtctgacgatcatggagtgaaggccgaagaatgtggataaagaaagggaaggagaatcaaataatgccccccaagttactaagtgtcttgctgaacttttgctttttctatgtgggtgaaggtaaaaagagataactcgagacagtgcaggaaaaatatcatttaaaacctaaccttgaggctgggcgtactggctcaggcctgtaatcctagcactttggaaggctgagactggtggatcacctgaggtcaggagttcaagaccagcctggccaatgtggcaaaaccccatctctactaaaaataccacaattagctgggcatggtggtgggcgcctgtaactccagccactcgggaggctgaggcaggagaatcacctgaatccggtggggcggaggttgcagtgagccgagattacgccatttcactccagcctgggcgaaagagcgaaactctgtctc

SEQ ID NO: 386814 - DNA, 391 bp, Homo sapiens
ggaatacttcaggataagtggtcaaggaatgttctcgaggaagcagtatttgagctgaaccctgagtgaagagctgtggaaagaccagaaacagtgtttcaggtgcagagaatagtaactgcaaagactgaggcgaaactaaaaaagtcatcgaaacccacactgagccctgctggcggggaactgatgactcctcgttggtacggtcgtctgccctgtccaacgtggggttcttgagaagctgattctgaaattgagattagggtacaggaagattcttgtgggggtgctcttgtgaggagtgaaggcagcgaggctaggcagaggttgcagtaagccaagatcgcgccactgcattccagcgtgggtgacagagtgagactcagtctca

SEQ ID NO: 386815 - DNA, 484 bp, Homo sapiens
acgacgggttctctcatagaaagaggagtggagcacacagaaggagcacaacgggatggcgaaggaagaggctggagcaatgcagctgcaagctgggaatgcaaagggttgacaaccaccactagaagctaggaagaggaatactggacttctagcctccagaactgtgagataatacatttattttgttttaagccacccaatgtatggtactttgtttcggtagcccccagaaaatgaacataccccccaattataacacaacaggaaacaagattcatggagtgaatggtagaaccagacctgaatgctgattctcttctcacctgaagtgccacagttaccttcttgttgtgtgatgatcaaaatgtgctctgaagacaactacctcacaaagaattgggggtgcttgagaaagaaaagaaaagaagaaaaaagaaaagaaaaaagaaagacaagttcctgagttccatctatgacctag

SEQ ID NO: 386816 - DNA, 538 bp, Homo sapiens
acgacgggttctctcatagaaagaggagtggagcacacagaaggagcacaacgggatggcgaaggaagaggctggagcaatgcagctgcaagctgggaatgcaaagggttgacaaccaccactagaagctaggaagaggcagggaaggtcgctacccacagtctcagagggaccttggccctgtgctcattttaatactggacttctagcctccagaactgtgagataatacatttattttgttttaagccacccaatgtatggtactttgtttcggtagcccccagaaaatgaacataccccccaattataacacaacaggaaacaagattcatggagtgaatggtagaaccagacctgaatgctgattctcttctcacctgaagtgccacagttaccttcttgttgtgtgatgatcaaaatgtgctctgaagacaactacctcacaaagaattgggggtgcttgagaaagaaaagaaaagaagaaaaaagaaaagaaaaaagaaagacaagttcctgagttccatctatgacctag

SEQ ID NO: 386817 - DNA, 2708 bp, Homo sapiens
attcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctg

SEQ ID NO: 386818 - DNA, 2405 bp, Homo sapiens
  misc_feature (2354)..(2354): n is a, c, g, or t
  misc_feature (2403)..(2403): n is a, c, g, or t
attcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggcagggggattttaaccatggcattatttcagataggttaagaattggttatatagaaaataatcaggtgattttgatgctttntagtgcatttgattatatctgttagctgttgctatcaaataaatgtgtngt

SEQ ID NO: 386819 - DNA, 1675 bp, Homo sapiens
  misc_feature (1655)..(1656): n is a, c, g, or t
  misc_feature (1659)..(1659): n is a, c, g, or t
  misc_feature (1661)..(1661): n is a, c, g, or t
  misc_feature (1663)..(1663): n is a, c, g, or t
attcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcgccactgtattccagcctgggtgannagnananattcgtctcaat

SEQ ID NO: 386820 - DNA, 2654 bp, Homo sapiens
attcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctg

SEQ ID NO: 386821 - DNA, 2350 bp, Homo sapiens
attcctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggcaggtggaatttgctgccttttttagtgcaatctgatttaatgaactgttttcagctggtatgactatctgatatataa

SEQ ID NO: 386822 - DNA, 451 bp, Homo sapiens
gcaaagatccttatcaaaatattagcatatcaacccagcaacataaaggagataatacaatgtcatcaagagggttttacccctgaaacgtaaagttagtctaacattcaaaaatcagtccatgtaactcaccatattaaaagaataaaggagaaaaacaatatgaccattatggagatgatgaaaaagcatttgaaaaaaattcaacacccacaaaaaaaatcaaaacaaatgacaaaaataaaaaataataataaaaagaaaaaattcaacacctactcatgataaaaattcttagctcctcagccaaattggaacataggctgagtgcagtggctcacacttgtaatcccaaaactttgtgaggctgaagcaggaggactgcctgaggccaagagttcaagataagcctagtcaacatagtgatatcctgtctctacaaaaaggtaaa

SEQ ID NO: 386823 - DNA, 603 bp, Homo sapiens
cctaggaactatgcccaggcagaaaaaagttactgtaggtgatgaagccagtgctccctgaaccaaataaaccctatcgacgttaccgaactgccgggcaaaaccagagcaactcacttacttggaaggtgaaaaacacttcaacatactccaggcggcaaccgacacttaggggccaggcagatgaaacaccatttgtttaaaaagtctattatttcactgtctcttcaacaaaggtggaaaactgatgattaaacactgaataatgccacccacttactaaacctatgattcactaataagcaggttcaatgcaattcataactttaaagaatgaattaccgaagccccttgcttcacaaattcccccaagaaacagaaagagcattcatcacatataacccgacaaccatttttactatggacacctacagatggcttctcttcctctaaggacacaatttccttcacaatcccacatgtaatcatttacaataccagaaacaaactccaactcagttccaccaactgggtttttaaaaatccttgtgcctaagaacgtcttttttccccaaagtaaaatgtgccattaaaaaatatttt

SEQ ID NO: 386824 - DNA, 410 bp, Homo sapiens
caatttctaacattcaaaataggattatggagtaaggcaatatgcctgcaagtcggacctatatctctcccttaagaatatgaaagatcagggctagtccataaattatagattttatagagtgagggtggtaaccttcccctttctgtcccataaggatagtagtaaatagaaataaagaggaaagactggagtgaaatgttagtttttcatctctgtgatctttactctggtgaaagaaggtgcattagataaatgaggatagtgttgaaggcaggaggggattctcctgttctgccccagccttgtcgtgcttcccatctgaggcctcatctgagaggtcattgcagtgagctgagatcacaccactgcactacaacctgggtgatagagtgagaccctgtctcaaa

SEQ ID NO: 386825 - DNA, 308 bp, Homo sapiens
caatttctaacattcaaaataggattatggagtaaggcaatatgcctgcaagtcggacctatatctctcccttaagaatatgaaagatcagggctagtccataaattatagattttatagagtgagggtggtaaccttcccctttctgtcccataaggatagtagtaaatagaaataaagaggaaagactggagtgaaatgttagtttttcatctctgtgatctttactctggtgaaagaaggtgcgcgcagtcttctaccatcagatacctacaagaggtcaatgtatagaatccctgatgacgcag

SEQ ID NO: 386826 - DNA, 807 bp, Homo sapiens
cagggccagaggccgtccaccccgcctcctgccatacaagctgcaaaggacacctgcttccaccttggaaatattagtgcagttatctggactatgtcccgacatttggctcataggaatgagcccagcggcgtccagttaagcctggcaggctaagtgcttatttatctccactctctcctgaaacgccactgaaacaccagagagtgaagtgcagagaacgggagagggggcagtggcagctgagcacgtctccaggctttgaaaagcagggaagggtgggcaggagaccccatgggccggcaaccaggaggacagccagcagggagcagctgggctgcaccatggggccacagaaagacacagtgggcagacatgggcagctcctggagggctgcagggggaatgtaccacggggcctcagaaagacacagcgggcaaacatgggcagcccctgggggtgctggggggatgtgggggcaaccagcagaagacagtgggtggctctgggcagaagggaggcgccttcctggggtcagcagtggggcccagctgccagcctcacatccccccaacccccaaggccaggagagacaatagagggggtgggggtcctctgccagagaacaaaggggcccagtggagcaaagccacatatgctgatactggggctctcctaaagtcacaggctcctgccctcagcagcccctgccactgccttcaccaggcccagctcacacacggcttggcaccgtgcacagagggatcaacggccaggggacccgacacattggaggctgcgctccc

SEQ ID NO: 386827 - DNA, 627 bp, Homo sapiens
ggcctcccaaagtgctgggattacaggcgtgagccactgcacccggctggaactgaattttaaattccatttacttttaatccacttaaatttaaatagccacctgtgatgggaggctaccatattggaaagcacagatatagacccttctttctcgaactttctagcccatctcccacaacactttcccacacatcatatactgtgaatttccattccgaacctctccttggatcttactcttcatatagaatgaccttccctccctcaacctcttcatttcctgtccacacctagttggcaaagcccaacttaaatggcaactctgccatgaagttgtcctgatcaccccaattaaaaattatctttcctttcctaaattcctctaacagtttgcctttatgttcttgttgtctattactcaataacaaatctctataaaccttagtttttgtcttaaaacaacaggaaacaatttatcatatctcatggcttctatgggtcaggaatttgggaagggctgggctgagtggttgtgatttggagacccttataaaggtggtgactgggactgaaatagggaatcggaactgctggggactaactggacatctttctctcttttcg

SEQ ID NO: 386828 - DNA, 381 bp, Homo sapiens
aaaaaactatgaatttatagagaaaactcccccaagctcctcaattttaaaagtcatcctttttaatgttcagttctatgagtttcacaatgtatacagtcatgtgaccaccatcactgtgaagatatagagcatttcttcacttgatgaatttccatgcctctctgtagttatctcctctcttcacctccaacctctgacaactgctgaactattttctaccttggtttcctcactttatgtagttttgcctttattaggatgccatataaatgtaataaaacaatgtaaccttttgcgtctggcctatttttctcaccatactgcatttgagattctaacatgttgcgtatattaatatgtaatactcactttcttttc

SEQ ID NO: 386829 - DNA, 104 bp, Homo sapiens
gtgggaactcgataaatgttgatttatgaatgaatgcagcgatgaatggttcatccagagtacaggtggagggatggagaccacagcaggaagcacagcctgtc

SEQ ID NO: 386830 - DNA, 451 bp, Homo sapiens
aaaatattattacaagattttttattaaagtggttctcagcatactttctcttattatagctgcagtctcaaaagtacaccgtagtggataaacaaagtatggtatatccttacaatcagtacattctgtcctaaaaaggaatgaagtctgctgtatacttcagcatagatgaacctggaaaacttgtcccaagtaaaagaatttagacacaaaagactgcatattatatgattccatttatacagaatttttatagggatctataggtggttgatggtttccaggggctagaggtaggggaagttgggaaaaagaagtgactgcttcatggatatagtttcttttcagtgaattggataagcatgatgttgcacagcattgtgaatatactaaaatccactgaactggtacaccttaaaatgattgagatggtggatttcatgttacata

SEQ ID NO: 386831 - DNA, 1208 bp, Homo sapiens
gagcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcgccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctggtgaccctggtgctgtggaacaaccagctcacgcacacaggcatggccttcctgggcatgacactgccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccactccacacccaccgagcagcggatttccgtgtccaagcccgggccggggccacaaggtgtttgtggtgacccgggtggagagcccgcccgagagggcagagc

SEQ ID NO: 386832 - DNA, 1300 bp, Homo sapiens
gagcggccgcccacatgatgcgcaagacgagctgcctgcagtatctggacgcccgcaacacgcccctgctggaccactcggcgcccttcgtggcccgtgccctgcgcatccgcagcagcctggcagtgctgcacttggagaacgccagcctgtcggggcggcccctcatgctgctcgccacggccctgaagatgaacatgaacctgcgggagctgtacctggcggacaacaagctcaacggcctgcaggactcggcccagctgggtaacctgctcaagttcaactgctccctgcagatcctggacctccggaacaaccacgtgctagactcgggtctggcctacatctgcgagggcctcaaggagcagaggaaggggctggtgaccctggtgctgtggaacaaccagctcacgcacacaggcatggccttcctgggcatgacactgccgcacactcagagcctggagacgctgaacctgggccacaaccccatcgggaacgagggtgtgcggcacctcaagaacgggctcatcagcaaccgcagcgtgctgcgcctcgggctggcctccaccaagctcacgtgcgagggcgcggtggcggtggcggagttcatcgctgagagcccccgcctcctgagactggaccttcgggagaacgagatcaagacaggcgggctcatggcactgtcgttggccctcaaggtgaaccactcactgctgcgcctggacctcgaccgtgaacccaagaaagaggcggtgagcaggggacggtcctgcagccctggggcgggcggaaggccgggtggtggggccggcctgagagccctagccaggcgctcccgccacaggtgaagagcttcatcgagacgcagaaggcgctgctggccgagatccagaacggctgcaagcgcaacttggtgctggcgcgggagagggaggagaaggagcagccgccacagctgtcggcctccatgcctgagaccaccgccaccgagccccagcccgacgacgagcccgccgctggggtgcagaacggggcccccagccccgcacccagcccggactcagactcagactcggactcggatggggaggaagaggaggaagaggaaggggagagggacgagaccccctgtcctgccctggtgccccccacggactccctgggccctggggacaggagtcccccaggcagcccactccacacccaccgagcagcggatttccgtgtccaagcccgggccggggccacaaggtgtttgtggtgacccgggtggagagcccgcccgagagggcagagc

SEQ ID NO: 386833 - DNA, 571 bp, Homo sapiens
  misc_feature (71)..(71): n is a, c, g, or t
taagtcacttttttttttggaaaatttttggttggttgttttgagacagagcctcactctgttgctcaagntgagtgcagcgcgtgatctcgcctcactgggacctctgtctcccagattcaagagattatcctgctcagcctcccgagtagctggggttgcaggtgcctgcctccccttccagctagttttttgtatttttagtggagatggggttttgccgcgttggtcgggctggtcttgagcttcctgccacaggtcatccacctgcgtcggcctcctaaggtgctgggattacaggcatgagccaccaagcctggcctgtttttttttgtttgttttgtttttgttttttttgttttgttttgttttttgagacaggtcctgctctgtcctgcagctggagctgcagtgagctgagaatgaaacactgcactccagcctgagttacagagcaagactctgtctcaaagaaaccccaaaaaagaaaaacagaaaaacccacacaccaaagaacttacttatgtcatcctgctgtttagtttctacataaagtgttttgctcctcagt

SEQ ID NO: 386834 - DNA, 1646 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386835 - DNA, 1809 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386836 - DNA, 815 bp, Homo sapiens
gggtattcaggtttggttgctttggagtacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactattgacttgggtttttttcttgggatgtggacactgtcctgcg

SEQ ID NO: 386837 - DNA, 1208 bp, Homo sapiens
  misc_feature (1169)..(1169): n is a, c, g, or t
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattctctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcagcctctgccagcaacctgaattactctttcccactctattgctcaaacggctctgagcgtaaagccaaatcagatataaattctacacacttctacactacaaaccatacaatgtattaaagtgaaaaccaataaacatcaaaaatcaataccatgtcaacatatacctcacaaactacctgccgacactcataaacctttacactctatataagtccatcatagaattaacactactcaaattactcttgcctctagttaaaaccaaaatccatatttacataccctaatactaaaaatagtacgggaccctatgatcaccagttaagagatataatcctaataatcaaatcaaacatgtattaataataacacgacaatgactcaaatctatattatcccatcacctacaccgactatacccacaataagacttttatattattataataaccatactttcactctaatttatgctatatctattataataccataccaacgaataataaaataacgccatataaccttacgtttcacaaatcatcactttactgtatgacccactcaaattgacaaatacgaccgcagctacttctccattctcaacgaacgatacactttttaactgatcacantacattaaatactttagatactacatatacgtactctag

SEQ ID NO: 386838 - DNA, 624 bp, Homo sapiens
ctcccttagaatattcaagtagtatttgtttatgtgccttttattgattaaatttgtagttactagaaaaattagaaagtacagttaaaacctaaagaaagtctataaaaccactgttaacatatcattacatattctagattattttctacatgcatatatacatacatttaacaaaaaggggtcatatttttgtaaacaactttgtaatttaatgactagttttctgtgctaataaattcctcagtatcctctgaataatagactagggagggtgggatgaggaatagcaaaatcttacagaataattaaattttgccaccttcgtatttttgttagcttcagtatcagacacagcacagcagccatctgaagagcaaagcaagtctcttgaaaaaccgaaacaaaaaaagaatcgctgtttcatgtgcaggaagaaagtgggacttactggtaaggacctaaatcaaatgtttaaaattaaaatgatgttttataataatgcatagcttactgttgttgacttcaattaagattgttcctgttcccttgagagttaatattggatatacttcaccttctgaattttcttaaggaaataaaaatagctttgattatacacct

SEQ ID NO: 386839 - DNA, 1677 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaaaaaaaagatatcactcagcataatgaatcga

SEQ ID NO: 386840 - DNA, 1634 bp, Homo sapiens
aaaattttaggtggttaaaatgtggtacgtaaattttatatgtctcaactctgtttcatgttaaatgtgttacagaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386841 - DNA, 2124 bp, Homo sapiens
acgcgcgccgccccgagcgggttgcgagcggttggctggcgggggtcggaagggccccgggcacactggggcgcgtcagttccccgcctcctccgagtctcaggtcctcttcgggatgtttttccacctgcggcgtttttcagaaaccagccggaggcagcccggtgtctccaactcctgactggcaccgggaagggaattggtctctttttttcctgcttgggtttagcttgcttaggattctaaattttttgtctgcttttttgaaatagttatatttaagttttagctacctaaaaaagtatgaaagaatattgtgtttgaaatctttttaacttggtttttaagtcacgtgctaactatcctacacagttgggacgctatgatttaccttcacatctcggaagttgtaaccagttgtgaggaagttaggaccttggggttacctaaagataatttatattaagttgttgggccataaaaactgggcagaattggccacgcgcggtgactcaacgcctgtaatcccagcactttgggaggccgacgcggactaatcacgaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386842 - DNA, 1641 bp, Homo sapiens
ggagggcggccggacggcgcagcagatacacagatacttaccatggtgtattactctcttcgtctccagacctataaaaaagaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386843 - DNA, 2156 bp, Homo sapiens
acgcgcgccgccccgagcgggttgcgagcggttggctggcgggggtcggaagggccccgggcacactggggcgcgtcagttccccgcctcctccgagtctcaggtcctcttcgggatgtttttccacctgcggcgtttttcagaaaccagccggaggcagcccggtgtctccaactcctgactggcaccgggaagggaattggtctctttttttcctgcttgggtttagcttgcttaggattctaaattttttgtctgcttttttgaaatagttatatttaagttttagctacctaaaaaagtatgaaagaatattgtgtttgaaatctttttaacttggtttttaagtcacgtgctaactatcctacacagttgggacgctatgatttaccttcacatctcggaagttgtaaccagttgtgaggaagttaggaccttggggttacctaaagataatttatattaagttgttgggccataaaaactgggcagaattggccacgcgcggtgactcaacgcctgtaatcccagcactttgggaggccgacgcggactaatcacgaggtcaggagatcgagaccatcctggccaacatggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386844 - DNA, 1755 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattctctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386845 - DNA, 1522 bp, Homo sapiens
gaagagagaaatttaaaattaaaaattttccatatttctatcacaaatattggtaatttgacaacatgtaatttgattgtcgtcttaataaaatttaatgttattgctaccaaatagagataaaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386846 - DNA, 1436 bp, Homo sapiens
cgagagccggaagcggagggcggccggccggcgcagcaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386847 - DNA, 1417 bp, Homo sapiens
gggtattcaggtttggttgctttggagtacagcttcaagtgaagttaatctgaggtgaagcaaacagaaaattgtggaggttttgttgtgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386848 - DNA, 1450 bp, Homo sapiens
gggtattcaggtttggttgctttggagtacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctggttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386849 - DNA, 1420 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgttaatgaaaaaaaagggcgcccg

SEQ ID NO: 386850 - DNA, 1155 bp, Homo sapiens
ctactcctgaagtcctttggaagcatgttaagtgaaatccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386851 - DNA, 1920 bp, Homo sapiens
gtcaaaaaaaaaaaggaaaaaagatagcctttctaaatctcacaaaccctcagacttcaagattagaagggtgagatttagtaattttcatcttgtccagtctgtctaatacagtgctgtttgcttcatttttcattcattattatgaagttacaaatatgtctttgaagttaaaaatgtggcaatggaggttaacatcaaatattaatgtttaaaatattgattcctgtgctccatttctaacaattgtatcataccataaaattctaatttgggggagcaggaccagttttatttaaagactggctgcacccattacatctcgattttggttttaactccaggcattttcttaaaattaagtagcatttattgtgtgttttaccatatgttcagaattaaattccttcctcatttaatccttacttattattattccaaaattacagatgcagaaactcaagctcagagaggctaatttgccttcattagtaagtagattgacactgaggcaggcaggctctagatcccgtgctcttcacctctcaactgcagtacagttcacatctccatgggaggttagcagagaaaagcaaatatcgaagctgtgttcttgttaacagttctttcagaggtattatttgatctttcttaaataaatgccaagactgccttctgacagtaggcttattctcacatcgtagtgtttggatttgaaaaatgttttacattttcaacctagcaactgtgtttttgttaagaagtaattgttgccatatcacaggtgaagaaacaagctcagaggactttctctagggcaaacctgcgtttgtagataggaataagaaatgaagctctcaggtagtgaataagaatgtagtttgtgagacagtgtatttagaatgattctttagtttacattgctgccctaaatatattgtgctgttcagtattaattatgccaaagaccttaatatttcatccttcaactcatgtatgtgtattactccatttccagggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386852 - DNA, 947 bp, Homo sapiens
  misc_feature (908)..(908): n is a, c, g, or t
  misc_feature (916)..(916): n is a, c, g, or t
  misc_feature (920)..(920): n is a, c, g, or t
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgngtttgatnccgntgtggaagagattagagacagcaaatc

SEQ ID NO: 386853 - DNA, 1004 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccaccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactggtaaggacctaaatcaaatgtttaaaattaaaatgatgttttataataatgcatagcttactgttgttgacttcaattaagattgttcctgttcccttgagagttaatattggatatacttcaccttctgaattttcttaaggaaataaaaatagctttgattatacacct

SEQ ID NO: 386854 - DNA, 1485 bp, Homo sapiens
gggtattcaggtttggttgctttggagtacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386855 - DNA, 1655 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccagatcaaaagacactgacttagctgcttaccagaaggggaacttgggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctggttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386856 - DNA, 801 bp, Homo sapiens
  misc_feature (762)..(762): n is a, c, g, or t
  misc_feature (770)..(770): n is a, c, g, or t
  misc_feature (774)..(774): n is a, c, g, or t
acgcgcgccgccccgagcgggttgcgagcggttggctggcgggggtcggaagggccccgggcacactggggcgcgtcagttccccgcctcctccgagtctcaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgngtttgatnccgntgtggaagagattagagacagcaaatc

SEQ ID NO: 386857 - DNA, 1648 bp, Homo sapiens
gggtattcaggtttggttgctttggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386858 - DNA, 1612 bp, Homo sapiens
gaagagagaaatttaaaattaaaaattttccatatttctatcacaaatattggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386859 - DNA, 1599 bp, Homo sapiens
cgagagccggaagcggagggcggccggccggcgcagcaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386860 - DNA, 1442 bp, Homo sapiens
gtgagccgtagcaagcagtgggttcggcggcgcgcagcgtgtcaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386861 - DNA, 1684 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaaaaaaaaaagtcgacgcggccgcgaatttagtagtagta

SEQ ID NO: 386862 - DNA, 1613 bp, Homo sapiens
gggtattcaggtttggttgctttggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctggttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386863 - DNA, 1623 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagagggtttgtgtgtatacaatatgaagaatgatctgaagtaattgtgctgtatttatgtttattcaccagtctttgattaaataaaaaggaaaaccagaaaaaaaagatatcactcagcataatgaatcga

SEQ ID NO: 386864 - DNA, 1592 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagattttggttttggttttgttttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaa

SEQ ID NO: 386865 - DNA, 1060 bp, Homo sapiens
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcagggtttgtatatgaactagcatgtattttgttatttgagtattataggccagacactatcctaggtgcatgtataaaaaaattgccagcttaaaatacatgtttttctgttttccctatgaacacaatactttatatctttaagtatttaattaacatgttggggagccatttcacacttacatgtaattttatcatcagcataaatgttgcaaattcaaaatttgtttagtttggaaaatataattaaatgaatgtgtggcagtgtta

SEQ ID NO: 386866 - DNA, 1262 bp, Homo sapiens
  misc_feature (1223)..(1223): n is a, c, g, or t
cgccggtaataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcagcctctgccagcaacctgaattactctttcccactctattgctcaaacggctctgagcgtaaagccaaatcagatataaattctacacacttctacactacaaaccatacaatgtattaaagtgaaaaccaataaacatcaaaaatcaataccatgtcaacatatacctcacaaactacctgccgacactcataaacctttacactctatataagtccatcatagaattaacactactcaaattactcttgcctctagttaaaaccaaaatccatatttacataccctaatactaaaaatagtacgggaccctatgatcaccagttaagagatataatcctaataatcaaatcaaacatgtattaataataacacgacaatgactcaaatctatattatcccatcacctacaccgactatacccacaataagacttttatattattataataaccatactttcactctaatttatgctatatctattataataccataccaacgaataataaaataacgccatataaccttacgtttcacaaatcatcactttactgtatgacccactcaaattgacaaatacgaccgcagctacttctccattctcaacgaacgatacactttttaactgatcacantacattaaatactttagatactacatatacgtactctag

SEQ ID NO: 386867 - DNA, 651 bp, Homo sapiens
gatggttcttgttttccttctggcatcaactgaggtcacttagtgggacttaggtggcaaatgagctgctttggagggcccagtttggctttgctctccttgtcttatgtgttggtggtactggctagaagtttgggctcagagcaccatcatgtgacctctgcagtatggtggttttagaacagtcttgttacatggtatctggcttccactgaacaagcattacagaagaaccaggcaaaagcttcatggcctcttctaatctgaccttgaaagtcatacgggattactttcacattttttggcatacaaatgacccaaagcactagcccagattccaggagaggggaattagattccacctgtcgatggggaaattgcaaggtcacagtgtacaagagcatgtgggatgcaggcatctttggaaaatataatctgccactggtttatttatgttaaaagcttgaataaataagacaggatggtaagaacagaactgagaacaatttcagttatatcaaaagttaattcataaaagcagacaattttcaggcttgctaatgaagcagaatttaaccctgtgcagtacataagagtcatacctaccacaaagaagtaaaggttaaaaataaaggactgcatattgctgta

SEQ ID NO: 386868 - DNA, 439 bp, Homo sapiens
tacaacatgtaagaattatgggagctgcaattcaagatgagatttgggtgggaatacagccaaaccatatcaaggatgcgctctctattcttcactttcccagtgacttatctaaaaatgatttctcccttctacgtgcaagacttccactccagtttcttttctccttatattatttgcttccagtttctaaaatatccttgggatcactttgagaacatgggaggagagaagcagagggcttcaggaaatctgatgaccataacttacgttttataagttcttgtacaaagtcaagaacaggtgaaatttccaggaagaatgtagaagacacagttaatcatgatgttattgggttgcccttaagtgggatgcatggtctccctaggggtcacaggctggcttctaaaaagtaactaatttttttctgattacaatc

SEQ ID NO: 386869 - DNA, 175 bp, Homo sapiens
cctcacttggctggagggaacagactccccttcccttgtggctctcaggagcctccaaaggccgctgcttctagttggccatcttggccccaccccgaaacagtaacctttgaagaataaaagaaaaagcaaaagagtagcattactaaaatattaaacggttacatttacagcc

SEQ ID NO: 386870 - DNA, 473 bp, Homo sapiens
tgagccagggctggagaagagcacaaattgggcctccagcccagcacacatcctgtcccctggggtgctgactgccatcattggcactgcgcccatctgagccaggcagtcccccggagcctcacaacagctctgggaagctagtgtcattcctcagtgcccagtgttaccagctcacaagtggccagccagggctccctggtttccactccgtgaaccgccatgccctccgttctgaagcatattcagaggcagaacacctggaaatcaggtgagctttgggaaccccacatattcttgctgtattctactccatcgtgtgaaccaagagtacagaagtcatcagagagcatgacttgcatctgtgtctcaagtctgtatctaaaggaaaagtccataaaatcacccaaggaaacatcctaagccttttctgttggtgttttttttctttgcttctgaatcatttgttttat

SEQ ID NO: 386871 - DNA, 492 bp, Homo sapiens
ctgttgggtaattgtttgctgacctttgtgactgtgctcattgtcttctcttttcttccctttctcttaacatctatctcccttattacttattctctgttttgctcattttgctgctcagtcatatattttatttcattattaatgtgtatataacttgatttttttaaattaaattttaagctatggagggtaggggtctataattttggcctctttattgccttgcatttttataaaagttatgtgcttcgtaaaaattggggaggattgcagagaattaatatctatcatttaatattttgaaagattgttgggtaaattcttttatttcacttattagttttttaaacatatgtcccagaatggttctatctcaatgaatagaagtcatctattcatctgcgaattgattttgttctttgtgtcatgtactgtgattgatgatatgaacagtcctcatttagtctttaccaccccctactttaaaaa

SEQ ID NO: 386872 - DNA, 394 bp, Homo sapiens
cataacccttttaagcgcttttgtaggcatactttgagttctagggaagaagtatggtacaatttctttatgataaagaaaagtatcaacctatagaggaaaggtaatagccaacaacatttgctatctgaggcatttatcctgcaggtttaccccaaagtgatctttggaatccattcagtaaatatgcaaggaattctgctacaacgataaaaaaatgaatcaagtactgggtgtctacacatgtcctggtactcatattattccactcaaaactacgtaatccatgtttgtgttatagttatattgtggctgtagggttgaataacttctattgctttaaaaagacaaataatttcatagaggtgaaaagagttacaacctgggtgtcagg

SEQ ID NO: 386873 - DNA, 365 bp, Homo sapiens
aatttgaaattttaaaagcctatcaagctaagaagattttacttgctgcatctataaatgtgggagaactgttctctttttgaggtcgacaaaatatcctaagcttctaagacttgccaggaagtaaccttccttactcagttgtaaggctgagaaccctgtaagtcaggtaccaggctagttttcccaagagggctttgtatgcattggctccataaagtcagccttagttccttaaaagtgtctgatcatatctgattcagtgagcatcattcacaaatatggcattccaggtaaggccttggttacataccaatgtttctaatcatgatctggtaagaagggcagacagatttttattgaac

SEQ ID NO: 386874 - DNA, 559 bp, Homo sapiens
gggatgaagtcgtcaggatgtggaaactgcattcagtgagtcagctccttgtatgatccttcagaactgctgatgtcgatggggtccttcagatcagctgacctcattagtttcactggtgtgcaggacctgaaaggatatctcccagacggggtcgcggctgggccgaggcgctcctcacatcccagacggggtggcggggcagaggcgctccccacatctcagacgatgggcagccgggcagagacgctcctcacttcctagatgggatggcggccgggaagaggtgctcctcacttcctagatgggatggcggctgggcagagacgctcctcactttccagactgggcagccaggcagagggtgctcctcacatcccagatgatgggtggccaggcagagacgctcctcacttcccagacggggtggcagccgggcagaggctgcaatctcggcattttgggaggccaaggcaggcggctgggaggtggaggttgtagcgagccgagatcacgccactgcactccagcctgggcaccattgagcactgagtgaacg

SEQ ID NO: 386875 - DNA, 358 bp, Homo sapiens
cagttactccaagcctccttaccctgcttttcttcctacataggacttaccaccaccatctgacagtgaattatatactgaatgtgtctatctgcttgttgtcgctttccactagtagaatgtaaactccaaaaaggcagttttgttcactgctgaatcccttgtgccagaaacagtgtctgccacataagtattggataatagtttttccaagtgaataagtgaatggtgtaagaagggacaaagtcccatctatctcaaattttaaaaaatgtgtagagatatgactttaatcagcatcttcaattactgaaacaatgtattttcataggagttaaagaatatatcatttttagaa

SEQ ID NO: 386876 - DNA, 231 bp, Homo sapiens
gttcctcacgtgtataatgaggataacaatacctgctttgtaaggatgatgcaaagactcgatgaggtaatgcttcacaagcactgagtggtataaagtttcatactggtataaagtcagggctcaatatgtttattgtcattattttatttgttcccactctcccatctctccaaggaaaacctaacccatgtcattggtcagacctgagttcaaatcctagttcttcca

SEQ ID NO: 386877 - DNA, 1340 bp, Homo sapiens
tgctccagcttggagtaccacccatagtcctcttcatttttcatgacagaaaaaagttggcaggaccctccttcccttcaccaactcctcctgatacgcaatgttcaaattagcacattttcacaagacctcatatctcccaggcctccaagctgcatgacaacaatgacatttactttaactgacttttctcaaaggactgaaaagaaataatattagaggaaatgctataccttgatggttctctatgttggttggtagtgttagcatctgggaaagccccgttattcccaaagcactacgtatagactatgggatcaagagccaatataacacttctagaaggcaggatccctaaccttctcccagtcaccaggctcttaatgctattttcttgggtatttcaatttcagtctgtctattctcttctctttagctctgtctgttgctcaaattcaagtaagtttctacttagctgcttttgaaacataatcagttttcattcctaaatccaaggtgataaattatacacaaatataataatacatttatgaagggctggcagtgttcatttatctctgcttccacacgccccttatgcacttttatccagataattttttaatttcctcaatatttcttcaaaatttgagatagactctcattttcttcttgcaatgaaaactaaattatgacatgctcaatgagcccgtgtggttgaattcagctataaaatcaaaccagcaattgctcagagcagatgaagaaattctctattaattctaaaatgagtttttactcaacacagaccacggttgaaaaaaacaaaatgatttcttctcatgtacctgatttcattgcctgcctagctcctttttccctgagtcctggaaccttcacccacctggatgaatggtcacatggcctggtggcttaatcttttgagtttgcccattccaagaacaggctcaactctctcacattaaatgtgatccaaaagccagagagtgcggtgaggccaagctctatttgttgcgttctctccctgctttgtagagataactctgccctgatgctggggtttgtagttcagtaaggaaatggcccactaactttttctcaattttccaagaattttagagaatgactggcacccagcaaaacaaagaaggctgttatctccccttcctttattgtcctgtctacttcatggtgtatcgcctccaccactccagacatccactttcagcctggttcagctaagctatggaaaatattttaaatggaatggagaaatgtaaaatttgccatgaaagtaaagatttgtttaaatcttagaa

SEQ ID NO: 386878 - DNA, 286 bp, Homo sapiens
tccaactgaaaaagctggataaaagacaaaacaaattttaaatgcatcattgagttggcacaaaaggaagaaatttgcaaatctcgaaaagaagtgagagcaaatgtgcagtccaaacactaaagccagctttcgctggtagggtttctgctgaactttggggtcactaagcttctgccttgagagacaaataagatggaaggataggagacaaaaacctaggtcctgcctcaggtgagaaggttaatagcaaacacctgtataaagctgggctcttgaaatctgt

SEQ ID NO: 386879 - DNA, 283 bp, Homo sapiens
gtcgacttttgagacagagtcccgctctgtcgcccaggctggagtgcagtggtgaccatctcggctcaccgcaaccccgcttaaacaaaaacaaaaacaaaaaacaaacaaacaaaaaaatccatggagcacatataatcatgtgaaagaaaattaaacaacaaaaattaaaacagcctgacacattttaatagaattccagacacagaaaaaaaacaaaacaaaactgaacactaggactagtctgaagagtggagtatgaattagacagcaaatttccctg

SEQ ID NO: 386880 - DNA, 11865 bp, Homo sapiens
gggctgggcctcccttccccataacactgagctgctctgctgggccaaccgtgctcctgggccagccagaggacccccatgaggcggcatgcaggcggggagcaggccacagaacgcagggtgaaacccaaggcgctctagaggagatgaattatggatccgccctcccggaatcctggctcggccctccccacgccacccagggccagtcgggtctgctcacagcccgaggaggccgcgtgtccagccgcgggcaagagaccgagcaggtccctgtgtctccaagtccctgagcccgtgacaccggccccaggccctgtagagagcaggcagccaccatggcgaaggaggaagatgaggagaagaaagccaagaaagggaagaaggggaagaaggcaccggagccggagaagcccaaacggagcctgaaggggacgtcgcggctgttcatgggcttccgcgaccgtacacccaagatctccaagaagggccagttccgcagcgcctcggccttcttctggggcctccacaccggcccccagaagaccaagcgcaagaggaaggcccgcaccgtgctcaagtccacgtcaaagctcatgacgcagatgcgcatgggcaagaagaagcgggcgatgaagggcaagaagccgtccttcatggtgatccgcttcccaggccgccgtggctacggccgcctgcggccgcgcgcccggtcactcagcaaagcgtccacggccatcaactggctcacaaaaaagttcctcctcaagaaggccgaggagtcgggcagcgaacaggccacagtggacgcctggctgcagcgctcgagctcccgcatgggctcccgcaaactccccttcccgtcgggtgccgagatcctgcggcctgggggccggctccggaggttcccccgcagccgcagcatctacgcgtcaggcgagcccctgggcttcctgcccttcgaggacgaggccccattccatcactcgggctcccgcaagtcgctgtacgggcttgagggcttccaggacctgggcgagtattatgactatcaccgcgacggcgacgactactacgaccggcagtcactccaccgctacgaggagcaggaaccctacctggcgggcctcggcccctacagcccggcctggccaccctacggcgaccactactacgggtacccgcccgaggatccctacgactactaccaccccgactattacggtggcccctttgatccggggtacacctacggctacggctacgacgattacgaacccccatatgcgcccccgtcggggtactcgtctccttacagctaccacgatgggtacgagggcgaggcgcacccttatggctactacctggatccctatgcgccgtacgacgcgccatacccaccctatgacctcccataccacactccctacgatgtaccctactttgatccctacggagtccactacaccgtcccctatgccgaaggcgtctatggcggtggggacgaggccatctacccccccgaggtgccctatttttacccggaggagtcggcttcggcctttgtgtacccctgggtaccaccgcccatcccgtcgccccacaacccgtatgcccacgccatggatgacatcgccgagctggaggaaccagaggacgcgggcgtagagcgtcaggggacctccttccgcctgcccagcgccgccttcttcgagcagcaaggcatggataagcccgccaggtccaagctgtccctcatccgcaagttccgcctcttcccgcgaccccaggtgaagctgtttgggaaggagaagctggaggtgcccctgccaccctctctggacattcctctccccttgggggatgcggacgaagaagaggacgaggaggagctgcccccggtttccgctgtgccctacggccaccctttctggggcttcctcacgccgcgccagcgcaacctccagcgcgcgctgtcggccttcggcgcccaccggggcctgggcttcggccctgagtttggccgccccgtgcctcgccctgccacctcgcttgcgcggttcctcaagaagacgctgtcggagaagaagcccatcgcgcggctcaggggcagccagaagacccgggcgggcggccctgctgtcagggaggcggcctacaaacgcttcggctacaagctggctggcatggaccccgagaagcccggcacgcccatcgtgctgaggagggcccagccgcgcgctcgcagcagcaacgacgcgcgccgcccgcccgcgccacagcccgcgcccaggaccctctcccactggagcgcgctcctgtctccgcccgtgcccccgcggcccccaagctccgggcccccgcccgcgccgccgctctccccggcgctctcgggcctgccccggccggcctcgccctacggctccctccgccgccacccgccgccctgggccgccccagcgcacgtgccaccggcgccgcaggccagcgggtgggccttcgtggagccccctgccgtgagcccggaggtgccccccgacctactagccttcccagggccccgaccctcgttcaggggctcccgccggagaggggcggctttcggcttccccggggcctctccacgggcgtcgcggaggcgagcttggtcaccgctggcctcgccccagccctcgctgaggagctcgccgggcctcggctactgctcacccttggcgcccccgtcgcctcagctgtccttgcgcacgggccccttccagccgcccttcctgcccccggcccgccggccccgctcgctgcaggagtccccagccccacgccgagccgctgggcgcctgggcccacccggctcgccgctgccgggctcacccaggccgccctcgccgcccctggggctctgccacagcccgcggcgcagctccctgaatctgccctcgcgcctcccgcacacgtggcggcgcctcagcgagccacccactcgggctgtgaagccgcaagtgcgcctgcccttccaccgaccgcccagggccggggcctggcgggcgcccctggaacaccgggagagcccgcgagaacccgaggactcagagacgccctggactgtgcccccactggcccccagctgggacgtggacatgcctcccacccaacgcccaccctccccctggccaggaggtgcaggcagccgccgaggcttttccaggccaccccctgtgccggaaaacccctttctccagctcctgggccctgtgccatcccccaccctccagcctgaggatccagctgctgatatgaccagggtcttcctgggcagacaccatgagccggggcctggacagctcaccaaatcagctggcccaacccctgagaagcctgaagaagaggccaccctgggggacccccagctgccagcagagaccaagcctccaaccccagcacctcccaaggatgtcactccccccaaggatatcactccccccaaggatgtcctcccagagcaaaagacattaaggcccagcctctcatacccactggctgcgtgtgaccagaccagggccacatggccaccatggcaccgctggggaacactgccccaagccgcagcccccttggcgcccatcagggccccagagcccctgcccaaggggggtgaacggcgccaggcagcccctgggcgttttgctgtggtcatgcctcgtgtgcagaagctgagctctttccagcgagttgggcctgcaaccctgaagcctcaagtccagcccattcaggaccccaagccaagagcctgtagtcttcgctggtcctgcctctggcttcgggcagatgcctatggaccctggccacgagtacacacccatccccagtcctgccacctgggccctggagctgcctgcctgtcccttaggggctcctgggaggaggtcggcccgccaagctggcggaacaagatgcactccatccgcaacctgccatccatgcggttccgtgagcagcacggggaggatggtgtggaggacatgacacagctggaagacctccaggaaaccactgtgctgtccaacctcaagattagatttgaacggaacctcatctacacatacattgggagcatcctggtgtcggtgaacccataccaaatgtttggaatctatgggccggagcaggtgcagcagtacaacggacgggccctgggagagaatcccccgcacctctttgctgttgcaaatctcgccttcgccaaaatgctcgatgccaaacagaaccagtgcataatcattagtggagagagcggctctggcaaaactgaggccaccaagctgattctgcgctacctggccgccatgaaccagaaacgggaggtcatgcagcagataaagatcctggaggcaacacccctcttggagtccttcggtaatgccaaaaccgtcaggaacgacaactccagccgctttgggaagtttgtggaaatctttctggaagggggcgtgatctctggtgccataacctcccagtacctgcttgagaaatccaggatcgtgtttcaggccaaaaacgagaggaattaccacatcttctacgagttgctggccgggttgcctgcccagctcaggcaggcctttagcctgcaagaggctgagacctactactatctgaaccagggtgggaactgtgagatagcaggaaagagcgatgcagatgactttcgccggctcctggctgccatggaggtgttgggcttcagcagtgaggaccaggacagcatcttccgcatcctggcctccatcctgcacctgggcaacgtctactttgagaagtatgagacggatgcacaggaggtggcctcagtggtgagtgcccgagagatccaggccgtggcagagctgctgcagatctcccctgagggcctgcagaaggccatcaccttcaaagtgaccgagacaatgcgagagaagatcttcacgcccctaactgtggagagcgctgtggatgccagggacgccatcgccaaggtcttgtatgcactgctgttcagctggctcatcaccagggtcaacgcgctggtgtccccaaggcaggacacactgtccatcgccatcctggacatctatggtttcgaggacctgagcttcaacagctttgagcagctgtgtattaactacgcaaacgagaaccttcagtaccttttcaacaagatcgtcttccaggaggagcaggaggagtacatccgtgagcagatagactggcaggagatcacctttgctgacaaccagccccgcatcaacctcatctcactgaagccttatggcatcctgcggatccttgacgaccagtgttgctttccccaggctacagaccacaccttcctacagaagtgccactaccatcatggcgccaacccgctctattccaaacccaagatgccgctgcctgagttcaccatcaagcactatgcaggcaaggtcacctaccaggtgcacaagttcctggacaagaaccacgaccaagtgcgccaggatgtgctggacctgttcgtacggagccggacacgggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctcttcgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggggatgaccctgcaggccacggcactccagcagcaacccctgagtgctgccctgagatccttgcccgcagagaaacccccagcaccagaggcacagccgacgtctgtgggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctcaggatcaatgacccctgtaaggggccagagccttggaggacactaagaggaggcaggaggagcaactcaaatccccaagaacacaagaagacccatcctgaactgggatggaatggcagcatgcaaacttggatcagatagcaggaggaactttcaaaagtctggcccactgtgcagtggagcagaaggcaggaccatgaggcctcctgccatgtacccattgcagaccctgcccctaactcctgcctatgacacagaagccccacaccagttgcccagatgaactggcctctgcctttggtttactcagggtctgatgttggaatctgctccaactccacaccctagcccttacatgtcctcctaaggggcccctccttgtgctgccagtcagcctggatttctggtctttggttatttctgtgcaaacaaaaggtgtgcctggcagccatttctccatggagttgctaagtggccggaaaacaggcctgagggaggaggcaggagttggagttaccttaggcccctgattcactggctatgaacagaccatcccccactccttgggtatccccaaccccagacccccatcacttgatgggccacacaagtttgagagtggtacaagggagaagtttgggaaaagccttcttggaaaatgggacattagcattgagttttgaaagatgagtaggagtttgctaagaatagatggaagacagcaggataaacattccagagaaaatcatgtttattccctgctgtatcttccagaacctaggaggatgcctaacagagagtaagcacttaaaaaatatttgtcatatgaatgaaaaaataaacgagtgaatgttgataga

SEQ ID NO: 386881 - DNA, 6537 bp, Homo sapiens
gattccatgcctctgtcccatccgggccttacttttctcatctgtagaatgggcacaggacaatgtccttcactgagggtgaggccaagacccaggtgcacaagttcctggacaagaaccacgaccaagtgcgccaggatgtgctggacctgttcgtacggagccggacacggtctcccggaccctgcctgtctgttttccctgccccgacccctgcccaggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctcttcgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggggatgaccctgcaggccacggcactccagcagcaacccctgagtgctgccctgagatccttgcccgcagagaaacccccagcaccagaggcacagccgacgtctgtgggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgaattgatggtgaagttccccctgaaggagatccagtcgacgcggacccagcggcccacggccaactccagctacccctatgtggagattgcgctgggggacgtggcggcccagcgcaccttgcagctgcagctggagcagggactggaactgtgtcgtgtggtggccgtgcacgtggagaacctgctcagtgcccatgagaagcggctcacattgccccccagcgagatcaccctgctctgacccagcccccagccctccagtaccttctgccagaagactcactgtgtggcctcagagaaatcactgaacctctcaggatcaatgacccctgtaaggggccagagccttggaggacactaagaggaggcaggaggagcaactcaaatccccaagaacacaagaagacccatcctgaactgggatggaatggcagcatgcaaacttggatcagatagcaggaggaactttcaaaagtctggcccactgtgcagtggagcagaaggcaggaccatgaggcctcctgccatgtacccattgcagaccctgcccctaactcctgcctatgacacagaagccccacaccagttgcccagatgaactggcctctgcctttggtttactcagggtctgatgttggaatctgctccaactccacaccctagcccttacatgtcctcctaaggggcccctccttgtgctgccagtcagcctggatttctggtctttggttatttctgtgcaaacaaaaggtgtgcctggcagccatttctccatggagttgctaagtggccggaaaacaggcctgagggaggaggcaggagttggagttaccttaggcccctgattcactggctatgaacagaccatcccccactccttgggtatccccaaccccagacccccatcacttgatgggccacacaagtttgagagtggtacaagggagaagtttgggaaaagccttcttggaaaatgggacattagcattgagttttgaaagatgagtaggagtttgctaagaatagatggaagacagcaggataaacattccagagaaaatcatgtttattccctgctgtatcttccagaacctaggaggatgcctaacagagagtaagcacttaaaaaatatttgtcatatgaatgaaaaaataaacgagtgaatgttgataga

SEQ ID NO: 386882 - DNA, 462 bp, Homo sapiens
tcctaggatagacagagagacagaggccaggattacccaggccattgttccccttttcaggtgcacaagttcctggacaagaaccacgaccaagtgcgccaggatgtgctggacctgttcgtacggagccggacacgggtaagcctcgcctcccaccgctctggccctgcccccaggcatgtccccacccccacacccagcctgccttcaggcctgggaccgtgttgccacgtcctggctccgcttagctttggccagacaaagacaagggtggcctggacaccctgttcctggcctgttcccacctagcttggctccgccctaaacctagcgcctcatcctgatcctgtcctctggctccccacagccccagtggctagactctggccccgctcccagttctaaccctgtaccccaccagctgtggccttgccctgtacttaccccactctgggccccacc

SEQ ID NO: 386883 - DNA, 808 bp, Homo sapiens
cattcaccagacccccagggtagggagggacccagctgtgcgcccacatgtatgtgccaagtggacaggtagagcatgtgcctgcacaccgtgtgcctccagccgggccccacaggcctgcgtatgtgcccacaggcctacaggaacacctgtgtgcctgggagttgtatgagctgtaaatgccattgagtgtgggtccatatgcaggtgtccacgcattttccccaggatgagcatggggttgtggtgctaagacagtctccatctctgccctcctagaggccccatgcaccaggtcacaagtgtcctttgagttgtcacacaagccaacatatggggtctgctggtgctggaagagttgcggttgggagggagctggcccatgcgcccatgtacctgcatatgcctttgttcaccccctagggcaggacacttgggagctcatgggagggcctgcctgggcactgagggtatgcgtgtgtctcatgtgtgagggtcgcatgcaggttctgggggccacagcattctgtaatgaggagacctgcaggacccacctggccttggggttccctccccaacaatggtagcaggccccaggtatgaccaagccaggggtcagtgggggaggggggtgcccttcaacctgcagacacagcctctctctctcacacagatgcactccatccgcaacctgccatccatgcggttccgtgagcagcacggggaggatggtgtggaggacatgacacagctggagtgagtgggcagggccggcggggtcagcaaggggtcaccatggggtccccac

SEQ ID NO: 386884 - DNA, 5670 bp, Homo sapiens
gattccatgcctctgtcccatccgggccttacttttctcatctgtagaatgggcacaggacaatgtccttcactgagggtgaggccaagacccaggtgcacaagttcctggacaagaaccacgaccaagtgcgccaggatgtgctggacctgttcgtacggagccggacacggtctcccggaccctgcctgtctgttttccctgccccgacccctgcccaggtggtggcacacctcttctccagccatgccccacaggctgcccctcagcgcctgggcaagagcagctccgtcactcggctctacaaggcgcacactgtggccgccaagttccagcagtcactcctggatctggtggaaaagatggagaggtgcaaccccttgttcatgcgttgcctgaagcccaaccacaagaaggagccaggtctctttgagccagatgtggtaatggcacaattacgctattcaggggtgctggagaccgtgaggatccgcaaggagggatttccagtgcgcctgcctttccaggggttcatcgacaggtactgctgtctagtggccctcaagcatgacctgccggctaatggggacatgtgtgtgtcagtgctgagtcgcctgtgcaaagtcatgccaaacatgtaccgtgttggggtcagcaagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggcaacgctatcagcagatgaggaggagtctggtgaagttccggtccctggtacacgcatacgtgagccgccgacgctatctcaagctgagggcagagtggaggtgccaggtggagggggcgctgctgtgggagcaggaggagctgagcaagcgggaggtagtcgctgtggggcacctggaggtaccggctgagctggctgggctcttgcaagcagtggcaggcctcgggctggcccaggtgcctcaggtggcccctgtgaggactcctcgactccaggctgagccccgtgtcacactgcccctggacatcaacaactatcctatggccaagtttgtccagtgccacttcaaggaacctgcctttgggatgctgacagtgcccctgaggacacccctcacgcagctgccagccgagcaccatgcagaagccgtgagcatcttcaagctgatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtgaccagttctcctgcccggtgcactcctggagtacgggggaagaggtggctggagacattctgaggcacagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaagagtcagacagtcttggagagcctgctgtgccccacaaggggctggactgctacctggatagcctcttcgaccctgtgctgtcctacggggatgcggacctggagaagccaacagccattgcctaccgcatgaaagggggaggccagcccggtggaggcagcagtagtggtactgaagacacccccaggagacccccagagccaaagccaatcccaggcctggatgcctccacattggctctgcagcaagccttcatccacaaacaggccgtgctgctggcccgggggatgaccctgcaggccacggcactccagcagcaacccctgagtgctgccctgagatccttgcccgcagagaaacccccagcaccagaggcacagccgacgtctgtgggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccacttcaccctccccagagctggtccggtactctacgctcaactctgagcacttcccacagcccacacagcagatcaagaatattgtcaggcagtaccagcagccgttccggggaggccggcctgaggccctcaggaaggatggcgggaaagtgttcatgaagcggccagaccctcatgaggaggccctgatgatcctgaaagggcagatgacccacctggcagctgcacctggcacccaggtgtccagagaggccgtggccctggtgaagccggtgaccagtgcaccaaggccatccatggcacccacttcagctctgccctcgcgatcgctggagccccctgaggaactcacgcagacgcggctgcaccgcctcatcaatcccaacttctacggctatcaggacgccccctggaagatcttcctgcgcaaagaggtgttttaccccaaggacagctacagccatcctgtgcagcttgacctcctgttccggcagatcctgcacgacacgctctccgaggcctgccttcgcatctctgaggatgagaggctcaggatgaaggccttgtttgcccagaaccagctggacacacagaagcctctggtaacggaaagcgtgaagcgggccgtggtcagcactgcacgagacacctgggaggtctacttctcccgcatcttccccgccacgggcagcgtgggcactggtgtgcagctcctagctgtgtcccacgtgggcatcaaactcctgaggatggtcaagggtggccaggaggccggcgggcagctgcgggtcctgcgtgcatacagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggactctgactacgtggtcgctgtgaggaacttcctgcctgaggaccctgcgctgctggctttccacaagggtgacatcatacacctgcagcccctagagccacctcgagtgggctacagtgctggctgcgtggttcgcaggaaggtggtgtacctggaggagctgcgacgtagaggccccgactttggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagagggtcccccagtcagggcccgctctgctgaccatggggaggacgccctggcgctcccaccctacacaatgctcgagtttgcccagaagtatttccgagaccctcagaggagaccccaggatggcctcaggctgaaatccaaggagcctcgggagtccagaaccttggaggacatgctttgcttcaccaagactcccctccaggaatccctcatcgaactcagcgacagcagcctcagcaagatggccaccgacatgttcctagctgtaatgaggttcatgggggatgccccactgaagggccagagtgacctggacgtgctttgtaacctcctgaagctgtgcggggaccatgaggtcatgcgggatgaatgttactgccaagttgtgaagcagatcacagacaataccagctccaagcaggacagctgccagcgaggctggaggctgctgtatatcgtgaccgcctaccacagctgctctgaggtcctccacccacacctcactcgcttcctccaagacgtgagccggaccccaggcctgccctttcaggggatcgccaaggcctgcgagcagaacctgcagaaaaccttgcgcttcggaggtcgtctggagctccccagcagcatagagcttcgggccatgttggcaggccgcagttccaagaggcaactctttcttcttcctggaggccttgaacgccatctcaaaatcaaaacatgcactgtggccctggacgtggtggaagagatatgtgctgagatggctctgacacgccctgaggccttcaatgaatatgttatcttcgttgtcaccaaccgtggccagcatgtgtgcccactcagtcgccgtgcttacatcctggatgtggcctcagagatggagcaggtggacggcggctacatgctctggttccggcgtgtgctctgggatcagccactcaagttcgagaatgagctatatgtgaccatgcactacaaccaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgcgggaagtccaggagtacatcccagcccagctctaccgtacaacggcaggctcgacctggctcaacctggtcagccagcaccggcagcagacacaggcgctcagcccccaccaggcccgtgcccagtttctgggcctcctcagcgccttacctatgttcggctcctccttcttcttcatccagagctgcagcaacattgctgtgccagccccttgcatccttgccatcaaccacaatggcctcaactttctcagcacagagactcatgtgagtggcctcagcctggcactgccatcgccaccctctgttccctggtccccaaccccctccaagaggccaagacctccagccgccgaagcccagttccactgcttaccaccttcatgatctcaggcaagtctcttccctcctctgagccttgctttcctcatctggaaaatgaggataagagttgagccccacccatagggctgttgtgaaggtgagatgaggtaaaacatactctatgcactcaaatagtacatctgtgtgcttaggctgccataataaaagaccacagactgagtaacttaaacaa

SEQ ID NO: 386885 - DNA, 231 bp, Homo sapiens
agtaaggaaactgaggcccaaagaacatacgaatcatgccccaagtcacaaatcttgtaattgccagaactgggacttgacaaggccccataaattctctaagtgacttgactttaccatatttataagagtagttggagctggaatgtgagggagcagggtaagaggggaaaggattgaactgactttactagagttctttaaaaattaaaacatggtcacttcatgacc

SEQ ID NO: 386886 - DNA, 602 bp, Homo sapiens
gctacaagaacatgttgtaacaatgacaaaaagttcaatgcatcacaaggactggctagaaaaaaaaagtcccaatatgccaagcaatttattgtataaaaatgtgaaaatgcaaagaaatgcagcatagtcttttcaacaaaatggtgcaaggcttactgtatgtttgtgggcaattgcaaataaatcctaccttgaaccatgccaaaaaccacaaatgcgttagagtgttaaatataaacacacaatgtagttgaataggtatctgatcttgaaatgagaagagtttttatcaacatcatgaaaaagaagaaatcttttaaaatgaaaatgtataaatttgctgacatgaaaattaaatgtctgtgggtttaaaactatgggaaaatatttcaacatctgtgtcaaacatgaacttaatatttttaccacatggagtgctactctctgtcccttaaaagataacttctctagtagaatcaggaagaaagtatttaaataagtattgcctggtatgtcttgtctgtgttgaatattttaaaaaatacaaagcaagttgataaataaaagggagagaagtatccttaatagtaaaaaacaaa

SEQ ID NO: 386887 - DNA, 496 bp, Homo sapiens
caagcagtttgggaagagtgtaattattacttgtaaacagttcattagcagaatagagcaaataggccttttgctacaggaaacaagttgctttcaacaccacagcagttttcactgtgctctagaatgttctttccccatcttctccatggtaaatggttgaaagacatttgtttggcaggtttttgggggttttattgtagtttttactatgaaaaattttaaacattaaaaaagtagagaaaataatatagtgaagttctatgtacctatcatgcagctttagcagttaactgattaatggccagctctcacctataccccatcccttctcccatcttggattattttgaaagcaaccccaatgtcaggccatttcatttgtaaatatttttagtaggtatgtctaaaagataaaaatttgttttaaaagatgcaaaacgatatcacatcttaaaacattttaactgattccttaataaattatcaaatatct

SEQ ID NO: 386888 - DNA, 367 bp, Homo sapiens
gttctccttcctatgtccaagtgttctcattgttcaattcccacctgtgagtgagaacatgcggtgtttggttttttgtccttgtgatagtttgctgagaatgatggtttccagctactttttgatttttagtagagacggggtttcatcacgttggccaggctggtctcgaactcctgacctcaagtgatctgcccacctcggcctcccaaagtgccaggatgaccggtgtgagccaccgtgcctggcccatttttccatttttgatcagtttacttctcaagctttgtacttggaattgtactctatgtgcctgaagatgcccctaataaatgtaataatgtacaggtatgtccagtgcattttc

SEQ ID NO: 386889 - DNA, 469 bp, Homo sapiens
ccatctaccccatacacccccagtgaacctaggtattctaatgtctttgtgttttctaagcctcatgaataagactgttgaataccacctccaccggatcaaaattaacacctggtgcactttctacagcaccttttttcttctccacaagtgagaggaatcttgatactttcaagcctgtatctagatctccaggtcatcaggctgaggcctgctgctggcacgactgctggctctgcttgaaggttgctggtccacaatggctagtggctgtagttcatgtccagcagctagttttttagaattctggttatcatcggggaaatcaaaaggctgtgcgtgggagttagagatggtgcttcccgcctgccccattcgattttgttctgcactgtaattagcccagttttgctcacttgcttgcttgtcgtaattgcggcaagaagaattgtttctgtcgccattaacc

SEQ ID NO: 386890 - DNA, 699 bp, Homo sapiens
actggaagactctagagaagtagagatttggtattggtttcagacacttcatgggaagcagtagaggataggagaaatcacatagcatgtggaagtgactccatttaaatttgaattttgacagtgacattaccaattatgtggacttacgcaagtaacttaacttctgtaagtctaggattccccatatgtaaaatggtatacactggtatctacacttataaaccttataaatctgaattacatgaagcatggtgccacataatactacacatgtactctgctagctcttgtctccttttctttctccccttactaaaatagcttaaagtgaatcatagattctatatggaataattatttataatattcatgacaatagtatttatcaataatttacactgagtattaaccatgcacaagccactgggctaaataaattctgtgtaggataaaaagtctctgtcctcaacaagcataaaatctggtagggctcatttacctgtgagatagggcagggtatgaaaagtgctagcacagtggcccaagatgccatggaagctagaggcagatgggagcagagctggccaaggggctacatgggtgaatcacagaactaattaccagagatggaaggtactttacagaagaggttcccaaacctggctgcacaccaaaactaagtggagagtttaaaaa

SEQ ID NO: 386891 - DNA, 189 bp, Homo sapiens
agcgagccgcacggtattgtaaatgttcaagagtgccattattacctctgttttacagatagtaaaccaggagttcaaaagacttgtctaagataaatgaaaactaactaactaactagcagtgaaacagtgatatctagtttctattctattcttatttcccttaccacatagttccatctccctact

SEQ ID NO: 386892 - DNA, 376 bp, Homo sapiens
tgaacatctagccagaaaccacagcacatacctgaagatctaaatgcatatataaacataagctgataccaggcctctccccaggctcatttgatcactatttcgggagctggggccctgctattgaaattgctgaaattccaagaatcattgccccaaccctgacatcttttcaattcttcacaacttgggggcaggtggggtgagaaaggggactgaagacctgctgctatgtctctaactcccgtggtgctcctctgactaggcattgggtgggcagtggtggtcttcagcaagaaccattatgtaggagaagagggtagacctctggctatcaggagcacacagttggactggcttgtggaggctgtggccc

SEQ ID NO: 386893 - DNA, 387 bp, Homo sapiens
tccaatattagtcatagacaccaagccactgtcttaagaatcttagaaaacatcaagcagaattagaacaaaaaacaaaaacaaaccaacaacaaccaaaagtaactgagatatatcctgtttaaaccatagaaaattgaaaccaaagagaaaatcttgaatacatctgaaaagaatgaggacattctctttagagaaacaaggattaaaactactgcagacttctcatcagaaactgtgcaactctgtaatctgagctactcgggagactgagacaggagaattgcttgaacataggagtcggaggttgcagtgagctgagatcatgcccctgcactccagcttgggtgacagagcaagactccgtcaaaaaaaaaaaagaaaaga

SEQ ID NO: 386894 - DNA, 379 bp, Homo sapiens
tgatggtgtaacagataacagaatgaaaggaaatggtttggtttctataaaggaaaaagaatggtttgtataaggaaaccattagtttcctgagattgctataccaaattatcaaaacttggtgtcttaaaacaatagaaattttttctcccacagttctggaggccagaaactcaaaatcagtatttggcggctgaaatcaaggtgttggcagcaccctctggaggctctcggacagaatctgtcccttgtgtctaacagattctgctggctgctggcattccttgacttgtggtcgtatcattcccatctcctcctccatagtcataacgctttctcctcttctctggcatttgcatcccttttataagacacgtat

SEQ ID NO: 386895 - DNA, 2431 bp, Homo sapiens
agagagagagagagagagagagagagagagagcgagagagcgtgagcgcgcgcaagctagcgagcaaaccagagagacagaccgagagagggaccaggagagagacccagagagagaagaagcagccagaagccgagctctgtcagggctcaacctccaacttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtagatagtggtggcagtgcagcaaccagagcactgtataccccgtgaagcatccaggcacccaaaccccggggctccccttcgcgtatttcaggattctcctttttacccctctaccaagctgtgaccctcaattcatatttatgaatctctacgcaaaaaataactacagaaaaattacttgtccctccaatattgcccagtataaccccatcaaagccaaacactgccatttgtccagttgctcatcttagtctgccaatctcccctagctgagggcactgcatgtattttattgcactctgcccgctgcaaaaagaacaagagattctactctccatagtggaagccttggctgtttgagaggcccagaacaaggagaattgttgactcccatctagatcagatgactctaacttactaggcagccaggttaggctaggccatgtgatcctgcgtgccacctcccctgccttcagcaaggcctactaggcataagtactgatagcaaaggtgggagccagttctacacccccaacccatttattggtttggaaattagtggggacaattggtactaaccaccgtctaccatgtatggccaaaataaatagaactagctctgccagcctggcaccaagatggctggtgccctgccatgtccagcccctcgggaaaatagtcccctccttggtacatctctcctccagaaaatct

SEQ ID NO: 386896 - DNA, 922 bp, Homo sapiens
agagagagagagagagagagagagagagagagcgagagagcgtgagcgcgcgcaagctagcgagcaaaccagagagacagaccgagagagggaccaggagagagacccagagagagaagaagcagccagaagccgagctctgtcagggctcaacctccaacttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgagaatagaggaagtacagaagcacagaagcatgatgaagccatcggtttcctacacagtagcaccttggatccaggaaggtgggcctggagggagacataggctcaaaatggaaaaataaaagcctggctcttt

SEQ ID NO: 386897 - DNA, 1549 bp, Homo sapiens
agagagagagagagagagagagagagagagagcgagagagcgtgagcgcgcgcaagctagcgagcaaaccagagagacagaccgagagagggaccaggagagagacccagagagagaagaagcagccagaagccgagctctgtcagggctcaacctccaacttgtttcagttcattcatccttctctcctttccgctcagactgtagagctcggtctctccaagtttgtgcctaagaagatgataatcacacaaacaagtcactgttacatgaccagccttgggattcttttcctgattaatattctccctggaaccactggtcaaggggaatcaagacgacaagaacccggggactttgtgaagcaggacattggcgggctgtctcctaagcatgccccagatattcctgatgacagcactgacaacatcactatcttcaccagaatcttggatcgtcttctggacggctatgacaaccggctgcgacctgggcttggagatgcagtgactgaagtgaagactgacatctacgtgaccagttttggccctgtgtcagacactgacatggagtacactattgatgtattttttcggcagacatggcatgatgaaagactgaaatttgatggccccatgaagatccttccactgaacaatctcctggctagtaagatctggacaccggacaccttcttccacaatggcaagaaatcagtggctcataacatgaccacgcccaacaagctgctcagattggtggacaacggaaccctcctctatacaatgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaaggtcatgccacacacttttgggacactatccttgacctgaaatctagagcagcaggtatcctcagtgtcatcttcaccctgatctgattttcactgcgcttcactttcacttcacttccgagcccttacttcttgggattaaggttataaaagctgttaagtttcacc

SEQ ID NO: 386898 - DNA, 254 bp, Homo sapiens
tacggcctgcgaggccaagaatgctcagcatctgctctctgatgggaggcgtgtcttatcgcctgctgtggacgcccacaggctctgccacgtggtcggcatttaagattgtccaggaagtgcagctgtaggtggacctttccctcgtcctggcaactgccttgagactgagtttctccatcttttagatgaggctgacacatgtgcctcagaggctctcctgaaggagtcacagacttgagcccttcacgcct

SEQ ID NO: 386899 - DNA, 532 bp, Homo sapiens
cccaccccccaacacagacacacacaaacacaccgcccctacaaacgtatacatgttaggttgagcttcctgctaggggtgacaagcgaagttggcagcaggtctggtgtgctggtgtttggggcacgtccagcctctttggaggtaggctattatagcttaggcaagaccacagacaggtagcataatctgggcctcttttaaaatggcaagaacggcttcaggtgaacttttttgttgcagagatttaattgcaagtaggtgccggttgaaaatgggagcgcaaggaaaaccactaatttccttggcacatgtgctgttgcaattaacctggtagagtgttaaggaatttaacttagccaagaggctttgagggaggattatatgcaagtttggggaaggaattgataagattctggggtatgggactagctacatacacgtgcgtgcaagtttacgttaaattatgtagcattttagatttagcagtattaaatggttgcttttcttggaatggcttctgactacatag

SEQ ID NO: 386900 - DNA, 689 bp, Homo sapiens
gatgcttccagttttacacatgaggagattcaggctctgagagaggtggtcattgtccaaggtgtcttgctacttaataagtaatagaggctgggcatggtggctcacgcctgtaattccagcacttttggaggctgagggaggcagatcacttgaggtcaggagttcaagaccagcctggccaacatggtgaaaccctgtctctactaaaaatacaaaaattagctgggcttggtggcgtgcacctgtaatctcagctacttgggaggctgaagcaggagaattgcttgggcctgggggctgaggctgcagtgagctgagattgcgccactgcactccagcctgggtgacagagtgagactctgtctcaaaaataataataataataataaaataagtaacagaggtaggctttggagcctttgtgtgtcctcttcctgcttttcccatgacacctctctgcagaaggttcatgcctagacctgcctggagaattccttgtgttacaggagatgtatgaaaaggagaacttcgtttccctggagcaattttgaaccttaattattggttttaatctttagcttttcaaattcaaagcttgtttggcttcttagttaaattaaaggtattattctcccatctatttaaatgagaatgctctaaaaatggcagcgtgatgtccctattgc

SEQ ID NO: 386901 - DNA, 815 bp, Homo sapiens
cccagagtcctcaggtactagttgccatccgtgcctctgtagctggcgtcttgggaagcgccaccttgagggccctctcatctctgtgctgtccatctgcattcagcaggttggcattcagctaatatttatagttcaccacgaaaacactgatattctcatagtgccattaaataacagaatccaaacatgcttcgaagtgtatatgaagtggattattttgccatacttctgactcattatttcctgaaatctgaaagaatataacattataaagctcctggcatatctaggggcagcatgaaaaactcagacagcaaatatgcaaatatcctgagatgtacacatttccagaggcttccagacagggctgtaaactacattacttaaatgctattatacttttaggttctttcacccctgataacatctcagcctgacagaagccccaacccaaagctgctagaatgctaagttttgatccaaaaagacccctggcctcacagttggtctggaatttgaacagagaacttgaaagcagaagtttccctggaaaaccaggatgtacaactgccatgagtcgccttttaagctggaacaatatcatgaaacaagaatggtgaccccttgaacttctagaaaaaatattttctatatgagatggaaaaacattattttctgttcttatggatgtgagaagcaatctgaccaaaatcttctggttctaaaaatacataaatagctagtggggcaatatgttaacaatttaataaagggtaaatggaagatctttgtacttgtattcttgcaacttt

SEQ ID NO: 386902 - DNA, 403 bp, Homo sapiens
ggggcagggctggaagcctggcaggcagtcaagactacccccacagtacagtcaggaaaagatgaggactcaggtaaggagagggatgtgggtggcaggggagggagatgaggggagagcatagccctccaggcttagcgaccacaggacatggggaggagtgagtgaaggagaaagtcaagaatggctctgggttcccagcttgagcctggggtaggcgaaacggcccctgacaatgcaggggtggacagaaagccagcttgtgggctctgctcagacatgaaaggcagaggggttcacaggacagccaggtggagatgtttcaatgaagagatctgaggcaccagagagaggtctgaacgggaagcgtgggagtctgtagagggaagaaggcctgggaaac

SEQ ID NO: 386903 - DNA, 845 bp, Homo sapiens
  misc_feature (1)..(1): n is a, c, g, or t
  misc_feature (474)..(474): n is a, c, g, or t
  misc_feature (541)..(541): n is a, c, g, or t
  misc_feature (665)..(665): n is a, c, g, or t
ngtctcagatatgggtattacagaggtgagcaagattctacaaggggccccccatctctgtagtttacaccctaatgagagggtgtaacaaacaacaaacaagtcaaccagtatataaatagaatcatttcagatcaagaaaaatgctggctgcacagaaaataaaacagggtaatggaaaatccagtgatacgccaagttctctaagtcctctgaatctccctggagctggaagtgagatggaagagaagaatgccactagtgacagatgttggagcatctgtttccatggcaaggcaactgctggaactgaactctgctctgaaaactagccatactcccagcatgcctgtgtttggggtcctagaagttggtagctttcctcaaaggatcatgtacttcaagatcctgttaattgattgaaaaaggcattccagaatatccagtctgagtgtaagaaccctgtggactctnctccccgggcacctcttctgtaggagccgatctgccccattgaggacctttcatctgcacaaggggncaggcattctcccaaggcctggcagacagtataggaagcaggatctgctcctgaagaaggggatggctcaagacagtgctgccgcccagacaatgaggaagccagctgggatagctagaaacanagcacagcacttaaatctcagcatcaagtgcttatctatgtcttcaatctgtcacatttggctccgactcctttttctcatgcatctattaggggatggaacaaatgtttcattcagcaatagcttagaatctcatgcccattataaagataaccataaataaatgaaagctagaaggcc

SEQ ID NO: 386904 - DNA, 480 bp, Homo sapiens
gaaatttagattctgatgaagggcaggtacagagaacaatttttataagaagcttttgattctgaattgatgataggtgtatatgtgtgtatatagagagatgtgtaatatatatatggaacacacatgcacacacatggtagttaccttccacgtttgttccaaaggcgctgtgaaaggtggactgggtgcaggatggaaaccgcctcactgtgatggattataagcctccaggcggtggcagcaggagaaatgaagctctgtcctgtcatttctgttcactagcagattttgatgactctatgccattcacacatatttggtgtgccgtgacacaattcagtcctttcactgcaaccaaagagggtacaaactcatagaataatttaggcttttaagaagcccttaaaatgtttaatgatgcctgtattaaagtgtttttaaggacgtgagttttgtccaatgtaatattcaaccgtt

SEQ ID NO: 386905 - DNA, 600 bp, Homo sapiens
gtgcgggggctgggaagtggctgggggtgcacagtcccacacctgtcattcactgaacaggcacgtattgacagcttgtggcgtgtcaggccctgtgcccaactctgggagtcaaggataacctgacagactcaggccactttaggaaaacgaaatccaccccaaccacacttagcgagtcaccctggccgggcctgggctgccctccagtcggtcagccggactggatttccacgcggccgagccctacgcctcccagaccctgagctccagtctgcacaggccaggtgtctggagccgggcctggtgacaggcatcccccaggtgggaggaggggctgtcctggctctgacctggatatcagatccagagctgagggggaggcgcagggtcaggaggggaggggttctgttctgagtttcccctggccaaggctgcagacaagggacgcagacaatcggcacattgtgagcaggggctgcaggatggaaccagcaagctgctgtgctgagcgccccaaacctgggcctacaggggtgagtgcctcccgttactcctgcagcaaggacccagggggtgccccaggccacccagcccctc

SEQ ID NO: 386906 - DNA, 665 bp, Homo sapiens
gtgcgggggctgggaagtggctgggggtgcacagtcccacacctgtcattcactgaacaggcacgtattgacagcttgtggcgtgtcaggccctgtgcccaactctgggagtcaaggataacctgacagactcaggccactttaggaaaacgaaatccaccccaaccacacttagcgagtcaccctggccgggcctgggctgccctccagtcggtcagccggactggatttccacgcggccgagccctacgcctcccagaccctgagctccagtctgcacaggccaggtgtctggagccgggcctggtgacaggcatcccccaggtgggaggaggggctgtcctggctctgacctggatatcagatccagagctgagggggaggcgcagggtcaggaggggaggggttctgttctgagtttcccctggccaaggctgcagacaagggacgcagacaatcggcacattgtgagcaggggctgcaggatggaaccagcaagctgctgtgctgagcgccccaaacctgggcctacaggggtgaagaccaagccctcctgcgggggctggagagccgtgggcctgctcctgctgctgctgctgctggtgctggccgctgtgggggttgtggctggagggcttcttggctctgctcagggccctcccaag

SEQ ID NO: 386907 - DNA, 220 bp, Homo sapiens
gttaaaatgctacaaacagggcaaagacaccttcaataaatattaagtgaattaatcagtccttttctggaacttaaaatcttgtagaatactcaaataataattttattttattttaaaatgcttttgtgccaagatattttatcaaatttctaaaatataattttttagttatataatagtctaacataaaatttaaaaaattatttattaagatatg

SEQ ID NO: 386908 - DNA, 451 bp, Homo sapiens
gaaatatttaagtttgttttattggttaaagcagaatagtaaaatcattttaatgattttaacatgtcaagtttaacaaagtgcatgataaatataaaaattagttgtttaaaaatcatcttcaaaatatgtatttcaaatcaataaggtcctctatattaatttgaaagtcactatgttttgatctgtttttaaatatttttctgtatggaacttttgaatgacatgtgaagaacatgtactgctaaaggatgtataaattaattcatcttgtaataaacagcaatcttattatttaaaacattaatgttaaaatgcattgctagctctgatatatttatttccacatatcaaattcattatttttacctatccaaataccacattctagtatctaaattggtaactcttatacccagatatgtgttgcacttaaaatatcttattgctt

SEQ ID NO: 386909 - DNA, 827 bp, Homo sapiens
cccgccatcatgctcggctaatttttgtagacacggggtttcaccatggccaggctggtcttgaactcctgacctcaggtgatccgacggcctcggcctcccaaagtgctgggagctacagcgcccagccggcatatttcattttattatttgactcccctagtgaaatgtaagcttcacaaggaagggattctgtcttagaacggtgcctggaatacaacagacgctcaataagtgggtgtcgaataaataaatgtcccacgctgaggcttaggtacgttatgatactcattttacaaaagagaaaactaggacacacaaagattaagtcattgggtcgcacacctagtaagtgggggaggcgagtcctcagcacacgcccaataacagcattattatgattactagccgcttactcaggccttgagctaagtgctttaccctgaatcatcgcgctcaatttagcaataaccccgagccggcaccgtcgcgaacgccactttccaaaggaggaagccagggccagacgttgccctgcaaggccggggctgggccgggttcgaacccggacgcctgacgcgccctccgctctcccagaggcgttaccttggtggcccccgcttcctccccacggagcccggcgctcacccccgggccggggtcggggtcgtgagcccacagctcagccaccatctccgtgtgaagaaactcaaacaacacagtatccgccatgccccctcctcgcacgcctaaagatgcgcccagcgcttccagctctcattggccaggcttggtaagccacgcctcttgcgtcatggcgcgagccc

SEQ ID NO: 386910 - DNA, 286 bp, Homo sapiens
gctctctctaccccctcatctaggtatgtgtatagctcatttatttaggggtgatgttaaaaaattgaatgcccttaatggcaagggaaccaaccaatcaatgtggatgccacaactttttcccctgttgactgttgttattggtatggaagtattttttttttctcccagcttttatttcaggttcaagggatacatatgcaggtttgttacatgggtaaattgcatattgtaggggtttagtatacagattatttcatcacccaggtaataagcgtagtacctg

SEQ ID NO: 386911 - DNA, 410 bp, Homo sapiens
tggacactcacctcaaggaggctgcgtgtgtacatgcatgcagaggaaagcccaggtgtagaggggctgacaaggagaggaggaaggaggagagaggagggagaactcctagcgattgaaagaaagataaatgggagctactggtgtgagtgggacaacacaacggaaccgtgggatgtctgaagacactgtgctcactcaaggaagcgtgaaagagaggaagaaaattggagacccatagaaaattaacattagataaggattctagatggttttttggttataaatacttagagctacttggttttagcctgatatctacaagttaatctgttgagttccagataaaaagaatactggtaatggatttagaagagaaatgaataaaagactgttatatttgctgcctg

SEQ ID NO: 386912 - DNA, 234 bp, Homo sapiens
cagaaaacatgcctgggcaggggacagacatcctgttcccattgagggactagtcggcctgaaaatgaagcccccaaggaggacagcagagacaagaagttcccgatagccttgagagactgcaaagattcacccacccctggactttcagtctcagagtcaataaaatagcttttgttgtactttactttgctcaagccagtttactttgtttcactgttatttatttattta

SEQ ID NO: 386913 - DNA, 432 bp, Homo sapiens
taattggtaacagaagcagcagtagcctgtgaggatgggaacatgaattaaaccctccttagtgctggtggtggatcacctccctcaagcatagccctttaatcgggttgtattcactttcataatctgcatctgcctctcccttcttttcttatattgttactgttttcaaatgaaaagtgtggaaggtaagtttttttttaattgtacttaattacaataacaaccagcagtaagatatatctttgccagttgctcttattcatggtgtagataaaaaaatctgagtacagtgggcaataaatagtggaaaaccaatcccactttatctttagattaaattgaatgtactttcttcttaaaaatactgttttgtttagttgttaaatcctgaaaagaaactagtatatttgctaactggagttatttgga

SEQ ID NO: 386914 - DNA, 5281 bp, Homo sapiens
  misc_feature (2256)..(2256): n is a, c, g, or t
acccgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattgaacccttgtactttgccttattttacaaattgaggattaccaattaaactttaactgaactaaggctaccaaatacattccctgttatctaaattataacatacaattattttataacaaaatatatctaatttttattggataaatatgaataaatattttctctcagggaaaataatttttgaaagtagggtgattgagtactaactaggaaggtattaacaccactttgtagttgtcctttacgtaactactcctttactgccaattaactatcaccataaaagtaataaaaaatgaaattatttagaacggggcaggcaaactacatcctgcaggccaaatctgtcccaccacctgttttcatatggcctgtggcctaataatgttcttacgttttccattggttgaaaaataatcaaaagaacattttgtgacgtgaaaattttatgacatctattatgtatcagttttaaaaattagaattgtatgaaattaagagtttcagagttcataaagtttgattggaacataccatgctcntttgtttacatatcatctgcagctgttttttgtttttaatatggaacgcttcacgaatttgcatgtcatccttgcgcagggaccattctgatcttctctgtaccattccagttttttagtatatgtgctgctgaagtgaggactgcagctgctttcttgaacaatagcagagttgagtggttgcaacacacactgaatgtgactgtcatcacttcacactgctgtttgacacatcacaaatcactgatgtggttgtaacgacagcattttgagtgccatgtatatcacatgaacccacattttattttttattaccagagcatatctattatagcaaaacaagaaaagtggactttgttgttatttttaaagtacagtagggtgtgaattattttgatgttgaattagacgacaaagcatctatatagctaagctaaaagaataaccattgacattaccagacaaaccactcatcacagtattcccaactcacaggcaagcaactgttagaaaaattagaaaatttaaaatggaaataacaaagcagaatttcttcgcaaaatgaaaatgaggctgcaacaacagtaagtctctaagtcaatcatttgttagccaagcaaagccatttattgatggtgtgaattaattatgtttggatgcagcagctgaatatatccagagaaaataaacttaagattactggcctttggcaagaacagttgcttaaagagttaaggacattgaaagcgacataaatagtcactttaaaaaggaaatgattctggatggttctttgactctatttttatttttacttagagacagggtcttgctctgttgcccaggctggagtgtagagacacagttacacctcaatgtaaccttgaactcctaggcttgagatcttcccatctcggcttcccaatgtgtgaaggttacaggtgtgagcccttatatgtggccctcgtgaatggtttagcactatccccttggtggtgtccttacgataatgagttatgagatcttgttgtttcaaagtatgtggcactcgccccccacactctcttgctcctgccttcgccatgtgaagtgccttctcctattttgccttctaccatgagtaaaagcttcctgaggcttccccagaagcagatgccagtgctatgcttcctatagcctggagaactgtgagccaattatacctcttttcttataaattacccagtatcaagtatttctttatagcaatgcaagaatggcctaaaacacaaggcaaaacaactttgatatggtacagtcattttgacaatcgatatttgaatcacaatatttgatgacaatatccttacacatttgtcatactatcaaagagaaagaaacaagatttccattcccacaaattttagtgagtatattttctgagttcagcatttttagggacctaggtgcaagtgcaaaggaaatttccctgtttcaaaatctatttaactgcaattgaggtgattcaacctaattttcagtaagaagtgattaaaataatgacatgctaaaaggcaaatttcaagggaagaaatgtaaaagaattttacaaatgctttccaagtgatgaatatgctcagttaatttcatatgctcctggattgatagcagtatttggcaatacctatctgtatgagaagacatttttaaagatgaaatgtgtaaaatcttattaccattagtattaatggttaatgatggttaatgataaccattaataggcaatcatttacaactgattttgatcacagggaacacttacttagaaccctgattagaggcaatgttattctcaccaaaaaaggcattacaaaaaattgggctatattttgaattttgtcaattaaaaaagcgtgggagcagtgtgaaggagaagaggcaagaacgacccctggaccgaccaaagcccgcgcgctgctgcgtcccacacccggtgcccacatcccgccgccgccgccgccgccgccatgcccaagagaaagactgaaggggatgctaaaggagataaagccaaggtgaaggatgaatcacagagaagatctgcgaggttgtctgctaaacctgctcctccaaagccagagcccaagcctaaaaaggcccctgcaaagaagggagagaaggtacccaaagggaaaaagagaaaagctgatgctggcaaggagcgggaaggtgctggagatcccaagtgaagtgtgtgcattttttataactgtacttctggtgactgtacagtttgaaatattctttatcaagttttataaaaatgcagaattttgttttactttttttaagctatgttgttagcacacagaacacttcattgttgtttttgggggaaggggtatgtgtcactaatagaatatctctgaagctggattgatacggggaaaacatctttcccttctagttttgagagacttcctcttggctcccaggaggagggatttcctgactttgacacacatggccaccttggcacaaaagccttgtggtatggaaaaacaaattcgtttttatgtcttcttttccctttccatctttcagcatagacttaacccttaagcccagacatctgttgggacctgacccccggtcattggttaccagtgtgtctggcaatctggactttccagtgatgccactgagatggcacctgtcaaaagagcagtggttccatttctagattatggatcttcggataaattctgccattttcatttcacttcctgaaagtcagggttggcttgtgaaaagttgttaaacaacatgctaaatgtgaaatgttaaccctctaaactttccctgttcagagcatcagatgaggacttcattgggttttatagtggctgatttttggtagtccattgaagaagagagtttgaaagttgtatactgttaatgactgtctgcccatgtcctgcctgaaataccatgattgtttatggaaagtatctttaataaagctggatacagtttgaaagaaaaa

SEQ ID NO: 386915 - DNA, 1714 bp, Homo sapiens
acccgcgacccacatccgatcggtaccggagcgggaggtgaggggtcggctcgcggatccagctgcagagcgacgtggggaattggaatggtgctttggatcttatggaggccatttggattctcaggaagatttctgaaactggaaagccatagcataactgaatcaaaatcgttgattccagtagcttggacatccctgacacagatgcttttggaagcacctggtattttcttattgggtcaaagaaaaagattctcaaccatgccagaaacagaaacacatgagagagagactgaattgttttcaccaccttctgatgtccgaggcatgacaaaacttgatagaacagcttttaaaaagacagtcaacattccagtgcttaaagtgaggaaagaaatagtcagtaaattgatgcgatccctaaaaagggcagcattgcagcgcccaggcataagacgtgtgattgaagatccggaagataaagaaagtagactaatcatgttggatccctataaaatatttactcatgattcctttgagaaagcagaactcagtgttttagagcagcttaatgtcagtccacagatctctaaatacaatttggaactaacatatgaacactttaagtcagaagaaatcttgagagctgtgcttcctgaaggtcaagatgtaacttcagggtttagcaggattggacatattgcacacctaaaccttcgagatcatcagctgcctttcaaacatttaattggccaggttatgattgacaaaaatccaggaatcacctcagcagtaaataaaataaataatattgacaatatgtaccgaaatttccaaatggaagtgctatctggagagcagaacatgatgacaaaggttcgagaaaacaactacacctatgaatttgatttttcaaaagtctattggaatcctcgtctgtctacagaacacagccgtatcacagaacttctcaaacctggggatgtcctatttgatgtttttgctggggttgggccctttgccattccagtagcaaagaaaaactgcactgtatttgccaatgatctcaatcctgaatctcataaatggctgttgtacaactgtaaattaaataaagtggaccaaaaggtgaaagtcttcaacttggatgggaaagacttcctccaaggaccagtcaaagaagagttaatgcagctgctgggtctgtcaaaagaaagaaaaccctctgtgcacgttgtcatgaacttgccagcaaaagctatagagtttcttagtgctttcaagtggcttttagatgggcagccatgcagcagtgagttccttcccatagtgcattgttatagcttttccaaagatgctaaccctgctgaggatgttcggcaaagggctggagctgtgttaggcatttctctggaggcatgcagttcagttcacctggtaagaaatgtggccccaaacaaggaaatgctgtgcatcacgtttcagattcctgcctctgtcctctacaagaaccagaccagaaatccagagaatcatgaagatccacctcttaaaaggcagaggacggctgaagccttttcagacgaaaaaacacaaattgtttcaaacacttaattggaaatgttttctccatctccctaccagacttacatgtagtgaaatagaatttgtattatttaataaaattttagggtttggtttttactattga

SEQ ID NO: 386916 - DNA, 847 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgcgacgtcgacgggccaggctggctccgacgtgttagccttcctgtgccagccggtgtgacgactgtttcccctttaacgg

SEQ ID NO: 386917 - DNA, 837 bp, Homo sapiens
  misc_feature (21)..(21): n is a, c, g, or t
ccccccaccaccaacacccanacccacccaaaaaaaaaaaaatcaaaccccaacacccccctaggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggttccatgtcttgtcgccgaaaatcctggaagcagtgtgtgcagcgaggttctgccgactgcgggctttacttaaacatattcccccaggtgattctctcccccatcatccaccacaaacttgttatttctcgcaacgatgcaccatactatacctcatatcatcttcctacaaatcgccacctgcactcctcctcctttcctctctcatctttttcactccgacttttattcacctgaaacccaccccctcccctcagccttcctcccccgcattactttatcatatgaatccaacaatacaccaccccccttccccgaaccccccgccacacaaacgttaaacccaccagccgacacactcgagtcaaaccgcccactactcagaattaaatatataaaatgcgatcaaccacaaaacacg

SEQ ID NO: 386918 - DNA, 901 bp, Homo sapiens
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgacaatatctgaaagtcttctgctggaccaggaacccctacagtggacagtgtgcttcctgcttttccacgcagttcgacaggaaaaccatcccaaagtgaacaaaaatggaagcctgcgaagttcatcatgcaagacattgatgccactcacgtctttgtaatagcagaattggttaacgtcctccaggagcgagcgggtgaattaatggaccaaaatgctttttcccttacccagaaatgaaaatactcaatatggaccattcaggaattataagcagcaaatgtgaaagacttgccactcgatatcttaggtgactgattagacgtagagggttgttttagttgttttaggagcatgccacgggaaagaccaaaggatcatttgttcagaaaaaaacctggaactgattttgttataccatagaattaa

SEQ ID NO: 386919 - DNA, 834 bp, Homo sapiens
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagggtaagattttttattctggaattatttaattgttttctggtatgttcataactaatgtctttaaaataacttacttatagtgaaaataataaggggagttgtgaacaattttcaggtaaacacggtgttccagaatacagcaggagcatctgggcatttttgtggctgtaagttttaaactttgcttaaagctctcataatagtgacctgcagtacacgcttgactatgactaagccatggatcagaggtctaattaagcctgattgccagagcaatgagaggatgtttcagacatcatatttttgttgtttagactgctttatttttaactttccaggggcattaaaaaaaaaaaaagaggaaaaagatgcaaccatccacctgagtaaagataatatatataagtaattgttctttaagggcaatgagcgagccgtattgtataatgttctcctttcatcactgtttcgttcattgctcgtgtggaattagagtggttgatttgggggaatctggggg

SEQ ID NO: 386920 - DNA, 1196 bp, Homo sapiens
ttgtatcagcaattgcttgaaaatattccaaaaatatgagtaaaataggaaagctgccattaggggtctcatttttaaattttacagaacacctaagcctgatcttctccatccagttgtatagatctagctggagagaaagcagatgttttaagaactcgaaattgctgaactaatgtatacccttgtctctgtaatatgttccacaacatggaacaatccataccacctaggcttctctctgctagaccatcatgcctccatgtcttcttatgtcacctggaaggagttgagacagtgatttaatttcccaggacacggaataactcttaaaatggaattgtgatgttggtataaagcaagtggccttaatgataaatgctattttaatatcttgaaattatgttatacaggcattcatttctaacgtttcttgaatatcaaatacaaagttaacaagaaaaaggaacattaacagaaatctctaaaagttagaaatgtacaggtaaagactaaaaattgataggaggtttagttgtgtttcctacccggaaatcaaaatttgaaaagcagtaaaggcatttgccctgctctgcctccttcacataggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgacaatatctgaaagtcttctgctggaccaggaacccctacagtggacagtgtgcttcctgcttttccacgcagttcgacaggaaaaccatcccaaagtgaacaaaaatggaagcctgcgaagttcatcatgcaagacattgatgccactcacgtctttgtaatagcagaattggttaacgtcctccaggagcgagcgggtgaattaatggaccaaaatgctttttcccttacccagaaatgaaaatactcaatatggaccattcaggaattataagcagcaaatgtgaaagacttgccactcgatatcttaggtgactgattagacgtagagggttgttttagttgttttaggagcatgccacgggaaagaccaaaggatcatttgttcagaaaaaaacctggaactgattttgttataccatagaattaa

SEQ ID NO: 386921 - DNA, 2903 bp, Homo sapiens
  misc_feature (1212)..(1212): n is a, c, g, or t
  misc_feature (1717)..(1717): n is a, c, g, or t
accagtttctgcacccctctttcttgcagccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggtgagctccttccttccttacctttcttcatgcccggcagaggtgcaggtgcagcccttgcttgctcagagcctggcgactcccactcccccgggtcccgctcgcacccatccaggccccagaatcttctcatccacaggcccctgagagccccccaatgccctgtccccctccccccagctcgcctgtcttcccacccctcccgcacccttccccatcccaggcttaccacctgcctgcacccgagtgaattgtctgcagactgcgggctcccatgctgggactgctagccaccaatgagggcagggacgatgaagtgactcgcccaaaagagctatttggtgactgggttgagcctattccaaacatcaggcgtgccagccagacccagtctcgctgccgcagagagtggtccatagttcatgcctcaagcgtaagtggatcaactcaagcaagagttgcccacaacttatgccaatcagaaacgatggacgcaggaaacagctagggaccccctgccatggagctcgccttcacatcctcatgctactcgttttactttacttcctccgttctctcctgctgaggttcgtggggtgagagttgatgcatgtttgcgtgtcaatgcgcgcgtgagtttttcatgccacacagcgtttccctcactttgctcagtgtgccttttccttcccttttccttcacatctgctctagactgatcgcataaatccagatgacatagatttagaaaatgagccctggtataaattcttttcagaactggagtttggacgcccggtaagtgaggctagactattaatataagaaaactaggagtatactgtttgatttctaaaatacaattatcagtagacgtgggtgtcattcagagaacaaaggccgaatgcataatgtatacacacacttggtacagcgtagtccagattcatttctgtaccaaatggtcaaatgtgctcagacatttcctatgtggtttgtaggtcattcattaagatttctttanatctaattcattacaagttcaaaatcttgaggtagtttctgtgatggaatattcagacaattattacagctgtatagaagatttgtatttgtttacagtctatttggtctagttcaagcagaagagcaccttgacattgagtcctgtttgctgagcaaacatcaggcacctggagagtgcgggcttctgtcttcattatctcctcgaggcctcctgatgtcccgccaagaagaagaaaatggggactggaggggttaagtaatgtgcacaaaatagtaaatggcagagtaagaagttaaacgcagagcctgttaaagaaaaatgaaaatctctgggcagttctcactataatatactgccagagtaatcccactacaaaatacagtcacgtgttgcttaaggatgtggacgggttctgagaaatgtgtcatcaggtggacttgccattgtgcaaacatcgcagagtacttacacaaacccagatgctagagcctgctacacgccnaggctgtgtgctatggcccgttgctcctgggctacaaacctgtacagcaggttcctgcactccatactgtaggcaactgtaatgcaatggtaggtatttgtgtacctaaacatatctaaacatagaaaaggcatggtaaaaatacagtcttataatcccataggaccaccatcatatataggtgcatcgttgacggaaacgtcattatgcaacacatgactgtacctagtttaccattagggatataaggaaagaaaaaaatcaggaagtcctgtggatcttaatttccagacttgctagtgaaagccatcacagcttctctaatccccagactcccgccagaggaagcccagaggttgggccttattgcttagcctgtttgggataaagagtcaacttgaggccgagcacggtggctcacacctgtaatcccagcactttgggaggccgaggcaggcggatcacgaaatcaacagattgagaccattctggccaacatggtgaaaccccgtctctgctaaaaatacaaacattagttgggcatggtggcgggtgcctgtagtcccagctacttgggagaccgaggcaggagaatcgcttgaacctgggaggcggagattgcagtgagctgggatcacgccactgcactccagcctgggcgacagagtgagactccatctcaaaaaaaaaaaaaaaaaatagtcaactggaggttcagttaacaacttccctgattaggaactgtatccaccaacagcagtgcatttgatgtgtgtcagttacacacgtttttatgcgttttagactcttaaataacctaccaattacactgatagtttttttagaaatcaggatataaccatttctataccatatgctgatttatatacttgcatatggaccatatatggtttactgattggtgatggtagtctcttttgtccattaaactgcaaaggagacttggttagactcaaggtagcttattgaaccgaatcaaaagtgactgtaaacgaatataaaccaaaggatttttcttagggttattatctcataggaggaatgttttctctcattttttctcatttgtatcttagtgtgaatgtaaatgtattttatttcaaggaaaaacattctctagctttattttatatgtattgttgctgttggttagaaagtttatagg

SEQ ID NO: 386922 - DNA, 596 bp, Homo sapiens
tcccacatgcattgcgaataaagcagtgatgtgttcgttttttgaaatagatgtgtgttaacaccgggagattggaagctgtgatttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcaggtgaagttgggggccatgcggggagggactgcagctgcatatactttgcagcaagacccatgtaaagctggggtgtggccaagagctgctcccctggaatgcagacctgggcagccaagacaataagggatagaggcaaagaatgggaaagagagcagg

SEQ ID NO: 386923 - DNA, 704 bp, Homo sapiens
aggaccagccattttacttatggaaaacagtgtggcatattctgctgagcttccccctggaagaaccctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagaggtaagcttttttgacctttttgaaagcacagcataaaaataactggggcaaaacttagcctgaaagatttacgttgattgtgtgatttggatttaccaaacaaacatacacagacacatacacacacgcatacacac

SEQ ID NO: 386924 - DNA, 433 bp, Homo sapiens
gtgttgatcttgagaattattgctgtacatcacaaaaagaccatgtcaacgtgtctcttccagggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaaggtagcccagctggttttttgtttgtttgtttttgtttgtttgttcttcagtgggtttgaaaaggctgtatattttcaaaactaaaataggttatctttttctttagacatttttatgtttacccta

SEQ ID NO: 386925 - DNA, 4636 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacaggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386926 - DNA, 4487 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386927 - DNA, 4328 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386928 - DNA, 6923 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggtgagctccttccttccttacctttcttcatgcccggcagaggtgcaggtgcagcccttgcttgctcagagcctggcgactcccactcccccgggtcccgctcgcacccatccaggccccagaatcttctcatccacaggcccctgagagccccccaatgccctgtccccctccccccagctcgcctgtcttcccacccctcccgcacccttccccatcccaggcttaccacctgcctgcacccgagtgaattgtctgcagactgcgggctcccatgctgggactgctagccaccaatgagggcagggacgatgaagtgactcgcccaaaagagctatttggtgactgggttgagcctattccaaacatcaggcgtgccagccagacccagtctcgctgccgcagagagtggtccatagttcatgcctcaagcgtaagtggatcaactcaagcaagagttgcccacaacttatgccaatcagaaacgatggacgcaggaaacagctagggaccccctgccatggagctcgccttcacatcctcatgctactcgttttactttacttcctccgttctctcctgctgaggttcgtggggtgagagttgatgcatgtttgcgtgtcaatgcgcgcgtgagtttttcatgccacacagcgtttccctcactttgctcagtgtgccttttccttcccttttccttcacatctgctctagactgatcgcataaatccagatgacatagatttagaaaatgagccctggtataaattcttttcagaactggagtttggacgcccgcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcggaagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386929 - DNA, 4647 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacaggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386930 - DNA, 4274 bp, Homo sapiens
tctgacctgcagctgccttcttgctgtgtgttcaactgaccgtcctgttgcttgtgtatgagggagaaagagaatgagagagagagagaaagatttcggcttcctcttgttacaagggctctaactccatcatgagggtccccctctgatgacctaatctaaacctaattacctcccccacctggggtcagaggtctgctgtgacagatggcaccaccttaaccaccgctgcggccactcatagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386931 - DNA, 3864 bp, Homo sapiens
  misc_feature (10)..(10): n is a, c, g, or t
  misc_feature (12)..(12): n is a, c, g, or t
tggttagtgnancgggcgggcgccggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386932 - DNA, 4475 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacaggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgaggaatgttttttctcggaaacaccctttgtgaaaaatgagggctatatgggcggcgtt

SEQ ID NO: 386933 - DNA, 2041 bp, Homo sapiens
cggctactctgctggtggtttggtggcaggtggagatggtgacggcgcattggaaaccgtaaggcatgacaacgggaggcccgcggggtgtttcaggcgcgttgacgcaggtgcatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386934 - DNA, 1833 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactaca

SEQ ID NO: 386935 - DNA, 2375 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggctccccaataaacctgaatttcagacccattagcaatttttgtcacaaaggtaatcacttagaaatcatgtttattttgtataatgatttgtacatctcatctcagaattgaaagatacatgttctaatatattgtctttactgaccaaatacaagtgtatgtgtgtgtgtatgtgtgtgtatttatatatatatatatacacacacacatgcaggtgtatatacatacacatatatacacatgtgtatgcacacacatatatatatttatatgcaagattcatttgcatgtaactctaactgtgcctaatcattaatcagagtttaacttttaaaaaagttcataagtgcaatacttaattgctatcatagcttgctaatgagagttttccatattggctttttaatatttctttggatgaagggagaattttccaaatgcccttttcataacaagttgttttaattgcttcttattaaatccctcctcaggttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactaca

SEQ ID NO: 386936 - DNA, 2629 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggctccccaataaacctgaatttcagacccattagcaatttttgtcacaaaggtaatcacttagaaatcatgtttattttgtataatgatttgtacatctcatctcagaattgaaagatacatgttctaatatattgtctttactgaccaaatacaagtgtatgtgtgtgtgtatgtgtgtgtatttatatatatatatatacacacacacatgcaggtgtatatacatacacatatatacacatgtgtatgcacacacatatatatatttatatgcaagattcatttgcatgtaactctaactgtgcctaatcattaatcagagtttaacttttaaaaaagttcataagtgcaatacttaattgctatcatagcttgctaatgagagttttccatattggctttttaatatttctttggatgaagggagaattttccaaatgcccttttcataacaagttgttttaattgcttcttattaaatccctcctcaggttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactaca

SEQ ID NO: 386937 - DNA, 1752 bp, Homo sapiens
  misc_feature (10)..(10): n is a, c, g, or t
  misc_feature (12)..(12): n is a, c, g, or t
tggttagtgnancgggcgggcgccggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggctccccaataaacctgaatttcagacccattagcaatttttgtcacaaaggtaatcacttagaaatcatgtttattttgtataatgatttgtacatctcatctcagaattgaaagatacatgttctaatatattgtctttactgaccaaatacaagtgtatgtgtgtgtgtatgtgtgtgtatttatatatatatatatacacacacacatgcaggtgtatatacatacacatatatacacatgtgtatgcacacacatatatatatttatatgcaagattcatttgcatgtaactctaactgtgcctaatcattaatcagagtttaacttttaaaaaagttcataagtgcaatacttaattgctatcatagcttgctaatgagagttttccatattggctttttaatatttctttggatgaagggagaattttccaaatgcccttttcataacaagttgttttaattgcttcttattaaatccctcctcaggttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactaca

SEQ ID NO: 386938 - DNA, 445 bp, Homo sapiens
gagggcttctgacagattgcagacttgcttaaggctatgaagctcctagatcgcctaacaagagaagcgcacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386939 - DNA, 1002 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgacaatatctgaaagtcttctgctggaccaggaacccctacagtggacagtgtgcttcctgcttttccacgcagttcgacaggaaaaccatcccaaagtgaacaaaaatggaagcctgcgaagttcatcatgcaagacattgatgccactcacgtctttgtaatagcagaattggttaacgtcctccaggagcgagcgggtgaattaatggaccaaaatgctttttcccttacccagaaatgaaaatactcaatatggaccattcaggaattataagcagcaaatgtgaaagacttgccactcgatatcttaggtgactgattagacgtagagggttgttttagttgttttaggagcatgccacgggaaagaccaaaggatcatttgttcagaaaaaaacctggaactgattttgttataccatagaattaa

SEQ ID NO: 386940 - DNA, 1169 bp, Homo sapiens
  misc_feature (1041)..(1041): n is a, c, g, or t
  misc_feature (1045)..(1045): n is a, c, g, or t
  misc_feature (1056)..(1056): n is a, c, g, or t
  misc_feature (1061)..(1061): n is a, c, g, or t
  misc_feature (1067)..(1067): n is a, c, g, or t
  misc_feature (1072)..(1072): n is a, c, g, or t
  misc_feature (1080)..(1081): n is a, c, g, or t
  misc_feature (1091)..(1091): n is a, c, g, or t
  misc_feature (1094)..(1094): n is a, c, g, or t
  misc_feature (1106)..(1107): n is a, c, g, or t
  misc_feature (1109)..(1109): n is a, c, g, or t
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcggtaagtaatttactcaccgtgatttccatggcaacctcaatgcggcaagtacaaccacaggagaaagatatgcggcatcaaggtgaggcgggagcgctcagcactcatgaccctatccccagggagaaactggggcagaggacccaacatgggaggaaatgggcaccatgctattccaagaccatgtctccacctgtgtctgagcctggtgtgggcacttagatgtctgaggtggtggagtagaagagaaaaaaaaaagtnttantacggcgcagntatcnttatgnggtantagctgcnngcgcgttaanctnctgaacttggtnnantatgctagaacccttgcatgtatgaagcgacgtcctcaatcatgatgatgagcttgcgta

SEQ ID NO: 386941 - DNA, 1214 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtaggatgggtttccttgctcgcaatgactattttatgctcagcaatgtttggaagaacgacacggtcaccttttttccccttctgtttgagcacatgttttcagttcatatattaggaggaggatttcttttcttttctcagagcgtgcataacaaaaggattgacttttctcatggaaatgagaactaatactggtttatctcattcattcccactgttggtttattctcagcttcaggaatgtttaaccaaagtgtgaaggataggctgaaaggacacactgtaacccagggtacaaaataagataaagatcttttatcagcagagagaatg

SEQ ID NO: 386942 - DNA, 572 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagccaaaaggttttagaagcgttcgaccaaacctacaagataaaagatcaccaactcaggcaccccctccaccagaaagaaaagagagctttcatagctctttgataaccagtcacacaaagggtgtcatttt

SEQ ID NO: 386943 - DNA, 303 bp, Homo sapiens
  misc_feature (10)..(10): n is a, c, g, or t
  misc_feature (12)..(12): n is a, c, g, or t
tggttagtgnancgggcgggcgccggcagcttctgagagcctgggcaggcagcagctggctgaccaagtccactggaagagaaggcttgtgccagccgggagaaggaagccggggacaggatgaaagcaacaacacctttgcaggtgaagttgggggccatgcggggagggactgcagctgcatatactttgcagcaagacccatgtaaagctggggtgtggccaagagctgctcccctggaatgcagacctgggcagccaagacaataagggatagaggcaaagaatgggaaagagagcagg

SEQ ID NO: 386944 - DNA, 786 bp, Homo sapiens
  misc_feature (13)..(14): n is a, c, g, or t
ttctagttaaacnnccccccgactactgtagcgaggctgggtggcggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaaccggccaaggactgggtacaa

SEQ ID NO: 386945 - DNA, 4581 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacaggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaatatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386946 - DNA, 5342 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggtgagctccttccttccttacctttcttcatgcccggcagaggtgcaggtgcagcccttgcttgctcagagcctggcgactcccactcccccgggtcccgctcgcacccatccaggccccagaatcttctcatccacaggcccctgagagccccccaatgccctgtccccctccccccagctcgcctgtcttcccacccctcccgcacccttccccatcccaggcttaccacctgcctgcacccgagtgaattgtctgcagactgcgggctcccatgctgggactgctagccaccaatgagggcagggacgatgaagtgactcgcccaaaagagctatttggtgactgggttgagcctattccaaacatcaggcgtgccagccagacccagtctcgctgccgcagagagtggtccatagttcatgcctcaagcgtaagtggatcaactcaagcaagagttgcccacaacttatgccaatcagaaacgatggacgcaggaaacagctagggaccccctgccatggagctcgccttcacatcctcatgctactcgttttactttacttcctccgttctctcctgctgaggttcgtggggtgagagttgatgcatgtttgcgtgtcaatgcgcgcgtgagtttttcatgccacacagcgtttccctcactttgctcagtgtgccttttccttcccttttccttcacatctgctctagactgatcgcataaatccagatgacatagatttagaaaatgagccctggtataaattcttttcagaactggagtttggacgcccgcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386947 - DNA, 4598 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386948 - DNA, 4717 bp, Homo sapiens
aggcgtgatctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccaaataacagtgaatggaaactcatcgaggtgccgtgattcccatgagttactatcagaggccgttttccccctcggcatattctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacaggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgcaaa

SEQ ID NO: 386949 - DNA, 3660 bp, Homo sapiens
  misc_feature (10)..(10): n is a, c, g, or t
  misc_feature (12)..(12): n is a, c, g, or t
tggttagtgnancgggcgggcgccggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386950 - DNA, 4154 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatagttcacagtgcctgaattacacctgctccgaaaactagctttgtatttcttatgactttgcataagaactgttcatctttggatcttgagcaccttacagataaaactttttatggcatctctttcatggacagtgattgatcttttcacaatgtatgtagcctctagaattttgtacatatgtttgctctttttttgtacagactatttagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtata

SEQ ID NO: 386951 - DNA, 2087 bp, Homo sapiens
  misc_feature (21)..(21): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaaggtagcccagctggttttttgtttgtttgtttttgtttgtttgttcttcagtgggtttgaaaaggctgtatattttcaaaactaaaataggttatctttttctttagacatttttatgtttacccta

SEQ ID NO: 386952 - DNA, 4058 bp, Homo sapiens
  misc_feature (21)..(21): n is a, c, g, or t
  misc_feature (2367)..(2367): n is a, c, g, or t
  misc_feature (2872)..(2872): n is a, c, g, or t
ccgagaggcgaatgaggaagnaaagctatcggctaggtagcgaggcctgggtgttaggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagccaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccgggtgagctccttccttccttacctttcttcatgcccggcagaggtgcaggtgcagcccttgcttgctcagagcctggcgactcccactcccccgggtcccgctcgcacccatccaggccccagaatcttctcatccacaggcccctgagagccccccaatgccctgtccccctccccccagctcgcctgtcttcccacccctcccgcacccttccccatcccaggcttaccacctgcctgcacccgagtgaattgtctgcagactgcgggctcccatgctgggactgctagccaccaatgagggcagggacgatgaagtgactcgcccaaaagagctatttggtgactgggttgagcctattccaaacatcaggcgtgccagccagacccagtctcgctgccgcagagagtggtccatagttcatgcctcaagcgtaagtggatcaactcaagcaagagttgcccacaacttatgccaatcagaaacgatggacgcaggaaacagctagggaccccctgccatggagctcgccttcacatcctcatgctactcgttttactttacttcctccgttctctcctgctgaggttcgtggggtgagagttgatgcatgtttgcgtgtcaatgcgcgcgtgagtttttcatgccacacagcgtttccctcactttgctcagtgtgccttttccttcccttttccttcacatctgctctagactgatcgcataaatccagatgacatagatttagaaaatgagccctggtataaattcttttcagaactggagtttggacgcccggtaagtgaggctagactattaatataagaaaactaggagtatactgtttgatttctaaaatacaattatcagtagacgtgggtgtcattcagagaacaaaggccgaatgcataatgtatacacacacttggtacagcgtagtccagattcatttctgtaccaaatggtcaaatgtgctcagacatttcctatgtggtttgtaggtcattcattaagatttctttanatctaattcattacaagttcaaaatcttgaggtagtttctgtgatggaatattcagacaattattacagctgtatagaagatttgtatttgtttacagtctatttggtctagttcaagcagaagagcaccttgacattgagtcctgtttgctgagcaaacatcaggcacctggagagtgcgggcttctgtcttcattatctcctcgaggcctcctgatgtcccgccaagaagaagaaaatggggactggaggggttaagtaatgtgcacaaaatagtaaatggcagagtaagaagttaaacgcagagcctgttaaagaaaaatgaaaatctctgggcagttctcactataatatactgccagagtaatcccactacaaaatacagtcacgtgttgcttaaggatgtggacgggttctgagaaatgtgtcatcaggtggacttgccattgtgcaaacatcgcagagtacttacacaaacccagatgctagagcctgctacacgccnaggctgtgtgctatggcccgttgctcctgggctacaaacctgtacagcaggttcctgcactccatactgtaggcaactgtaatgcaatggtaggtatttgtgtacctaaacatatctaaacatagaaaaggcatggtaaaaatacagtcttataatcccataggaccaccatcatatataggtgcatcgttgacggaaacgtcattatgcaacacatgactgtacctagtttaccattagggatataaggaaagaaaaaaatcaggaagtcctgtggatcttaatttccagacttgctagtgaaagccatcacagcttctctaatccccagactcccgccagaggaagcccagaggttgggccttattgcttagcctgtttgggataaagagtcaacttgaggccgagcacggtggctcacacctgtaatcccagcactttgggaggccgaggcaggcggatcacgaaatcaacagattgagaccattctggccaacatggtgaaaccccgtctctgctaaaaatacaaacattagttgggcatggtggcgggtgcctgtagtcccagctacttgggagaccgaggcaggagaatcgcttgaacctgggaggcggagattgcagtgagctgggatcacgccactgcactccagcctgggcgacagagtgagactccatctcaaaaaaaaaaaaaaaaaatagtcaactggaggttcagttaacaacttccctgattaggaactgtatccaccaacagcagtgcatttgatgtgtgtcagttacacacgtttttatgcgttttagactcttaaataacctaccaattacactgatagtttttttagaaatcaggatataaccatttctataccatatgctgatttatatacttgcatatggaccatatatggtttactgattggtgatggtagtctcttttgtccattaaactgcaaaggagacttggttagactcaaggtagcttattgaaccgaatcaaaagtgactgtaaacgaatataaaccaaaggatttttcttagggttattatctcataggaggaatgttttctctcattttttctcatttgtatcttagtgtgaatgtaaatgtattttatttcaaggaaaaacattctctagctttattttatatgtattgttgctgttggttagaaagtttatagg

SEQ ID NO: 386953 - DNA, 1210 bp, Homo sapiens
  misc_feature (10)..(10): n is a, c, g, or t
  misc_feature (12)..(12): n is a, c, g, or t
tggttagtgnancgggcgggcgccggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactaca

SEQ ID NO: 386954 - DNA, 452 bp, Homo sapiens
tgtcatgataggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagtaaggcatttccccccagggtggcctatgtttcgcttaggataaaaataagtctacatggcattcagtagaagaatcagtgcacctgccacagagagagcggatgtgtaatcttgctagtctatacatataccatattgacctcctctgctgggattgtagcaaatgttttccctgtcttctttcatgatactggagtgccctaaattagacttgaagtaatatggacacattttctgctttttgatcaa

SEQ ID NO: 386955 - DNA, 559 bp, Homo sapiens
tggacatctgactgtctcctagagaaagttgtttttctgccagagaaggtacagcaggcagggcattgcttcctatttagtcgaaggcttattttaaattgggactaggccaagttcaagtgcaggagcacactggcccctgggagagcctggccaggtacatttggcttgtgagaccagccgtcagcactttggctcatggaacacacgtctgtccgagcagtgcagacctggcttgtgtgaactgggctctgtgtgccctcagggaaaatgccgaggccacatctagaaattctggctgaggctgagagccgtgtgcagagctgcccccacacatttccttgtgtatattttgggttcaggctgacatttcctcttagcatgggtggaggtaatggctgaatttttaggaggcttgaatcccttctacaaatatgcctcctcgccctgtaaccaagttttgctgggttgcagttcaggaatgtatcttgctgcttgtacagcccatcatggaatgtgaggacttagctcagaagactaaagcactattccttctagg

SEQ ID NO: 386956 - DNA, 614 bp, Homo sapiens
gccatttgaagcaagttgacagttccatcagtttgtttttgtttttgtttttggttcaataatttgagttcaaccatcgtcattttaaacataattaatcccaacaaagttgcctatagtttaatttaaacctcacagcatttttaatttattttgcatgggtgtttaaatagttctgttacgaatattgtccctgcacagttctaaattgtccttttataaaaaaaaaaagtgatattctagtttcttcacaatgtagtgattatcagccttactaattaccttgtagcctttcttaatatgcacataatgcacattttccgatggctagaaaaatgcaaaacacagtggatatcattgcatctattttcatgtctttctaaaaacaggactattaaaatctctgggatacatgagatagtaaaaaatgaggattataaatgaatagcacataagaattattttcttgaatttaaacttattgcagccagtttcagcatgtaaatatataataatgtacactaacgcgtaaaccttgaacatcacaactacaaaatcaaccataacactcacgccgaaaccgctatacactactcgataacgtcaaaacacaa

SEQ ID NO: 386957 - DNA, 246 bp, Homo sapiens
agaaaaatgcaaaacacagtggatatcattgcatctattttcatgtctttctaaaaacaggactattaaaatctctgggatacatgagatagtaaaaaatgaggattataaatgaatagcacataagaattattttcttgaatttaaacttattgcagccagtttcagcatgtaaatatataataatgttggctagtgtgtaattcttgaactaagaaatataaataaaaataaaaagattgtgtg

SEQ ID NO: 386958 - DNA, 590 bp, Homo sapiens
atgagcagtgcctgtgtgcattgcaatctcagccaaccgaagtaaatgttattggagttttgtgctgtaaaattgctgctttcatgcccactgcatctgacaacaggaatccttggtctactaggaaggtgggaggttgttgtgccttctagccagattcctacattcctaagaaaagggctgggaagtggggtaaaacttctattgttcctaatgggctagggacaatgagactcaagttggtggcatatttggtcagagaaagagactaaacaacaaaaaaagtactaatattacttcctgcattaagcattaggacctgggaagttattcttttagagaaactcttcagtgtttgtagaataaaaaaagtaattccagaggcctcaggacctgggaagttattcttttagagaaactcttaagtgttcgtagaaaaaaaaaaagtaattccagagagtagtggattaatgacttaagtttttaattttcaggaaatttaaaaaagcatattttacaaatcataaaatcaagatcaataaatacattattgcattttgaagggcaacaatttaaaacccatataaatg

SEQ ID NO: 386959 - DNA, 589 bp, Homo sapiens
gacgatcctatagaagagtgtgctgaacctcagctacgaagtaaatgttattggagttttgtgctgtaaaattgctgctttcatgcccactgcatctgacaacaggaatccttggtctactaggaaggtgggaggttgttgtgccttctagccagattcctacattcctaagaaaagggctgggaagtggggtaaaacttctattgttcctaatgggctagggacaatgagactcaagttggtggcatatttggtcagagaaagagactaaacaacaaaaaaagtactaatattacttcctgcattaagcattaggacctgggaagttattcttttagagaaactcttcagtgtttgtagaataaaaaaagtaattccagaggcctcaggacctgggaagttattcttttagagaaactcttaagtgttcgtagaaaaaaaaaaagtaattccagagagtagtggattaatgacttaagtttttaattttcaggaaatttaaaaaagcatattttacaaatcataaaatcaagatcaataaatacattattgcattttgaagggcaacaatttaaaacccatataaatg

SEQ ID NO: 386960 - DNA, 456 bp, Homo sapiens
aaaagcaatacatacaatacaaaaataacaaagaaagcaagtaaaaaacagccagtataacaactatttatgtattgtttatgttgtgttagggattataagtaatctgaagattatttaaagtatgctggaggatgtgcataggttatatgcaaatactgtgccattttatataagcaagttaacgtttgcggattttggtgttccaggggagtcctggaatcaatttcccacagataccaagggacaactggatatctgatttttcattattacagataactagtaaacattctatatgcaggtttgattctttttaggataaattctaaagatagcattactagttcacatgcaaaacatcattaaaatttttaatgcatgttaccagattttccacttttcagaaagattgtgctaatttatcctagtagacatatccaaatttaaatatgt

SEQ ID NO: 386961 - DNA, 130 bp, Homo sapiens
aagattatgccactgcactccagcctgggcgacagagtgagagtctgtcttaaaaaaaaaaaatgtccgtcaacagattaatggctaaagataatggggtgtgtatacactatggaatacacttcaacct

SEQ ID NO: 386962 - DNA, 6767 bp, Homo sapiens
catggatcctttggattttgattccagttgatccctggagtaaggtcctaaccggggtctcccgaggtcgtttcgccgtccaggatggagcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctgagggcacttccgtaaggcaagtccttttagaggctatgaagaaaacagctgcatggcacataccaaagctgctgcacagccggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttctgagcccttctttctactttgtcaaacagttcttagttgctggctctgctcggcaccggggctgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaattgcacctcattccagtcaagcagaaaaacaggcacaggctcagtgtaggtcccaagagagggtgcctggactcagcaactcggacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataacaatctatggcaagcaact

SEQ ID NO: 386963 - DNA, 544 bp, Homo sapiens
aagccttactgggtgacccagtgttttacttgacttgcctgatgacgcctgtcgctgcactgctgcccagattgtttttcagatccctccaggggagggttttccccacacaacttcacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatatta

SEQ ID NO: 386964 - DNA, 5397 bp, Homo sapiens
ttctgagaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgca

SEQ ID NO: 386965 - DNA, 6764 bp, Homo sapiens
ttctgagaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctgagggcacttccgtaaggcaagtccttttagaggctatgaagaaaacagctgcatggcacataccaaagctgctgcacagccggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttctgagcccttctttctactttgtcaaacagttcttagttgctggctctgctcggcaccggggctgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaattgcacctcattccagtcaagcagaaaaacaggcacaggctcagtgtaggtcccaagagagggtgcctggactcagcaactcggacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataacaatctatggcaagcaact

SEQ ID NO: 386966 - DNA, 4265 bp, Homo sapiens
ttctgagaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatatta

SEQ ID NO: 386967 - DNA, 591 bp, Homo sapiens
aaaaaagaaaaagaatttatttaggagaggaaggaaaggcagtaatgatgatggtggaaaggaaacggtctagttcgcccaacaacggaatctgaaagtggtgggggctgggaagtggggtaggaaagaagttcttagaggcaacgcggaatcgcccttcccagggctccccaggagcagaggtcctgcgtaaaaaagacttaaaaattggagcactggatgccatggatcctttggattttgattccagttgatccctggagtaaggtcctaaccggggtctcccgaggtcgtttcgccgtccaggatggagcaggtctggcccctggaagggcgcgcgggctgcttggggacgggggcgccttttctcgcgcttcgcggtttcctctctcctactgcaggcagcgcgcgtttgcagcgttttgggaccgaactgatgcttctgggaaacgaaactaaacctctctgaagtttccagctcgggctttttttgtttcccgctatccggcgtggcccagtccgggcgcggaacgagggcggggccgtggccaccgcggcggaaacgacccgggccgggggcgggcggcgagg

SEQ ID NO: 386968 - DNA, 6838 bp, Homo sapiens
ttctgagaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctgagggcacttccgtaaggcaagtccttttagaggctatgaagaaaacagctgcatggcacataccaaagctgctgcacagccggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttctgagcccttctttctactttgtcaaacagttcttagttgctggctctgctcggcaccggggctgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaattgcacctcattccagtcaagcagaaaaacaggcacaggctcagtgtaggtcccaagagagggtgcctggactcagcaactcggacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataacaatctatggcaagcaact

SEQ ID NO: 386969 - DNA, 4819 bp, Homo sapiens
ttctgagaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctggacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccagattgtttttcagatccctccaggggagggttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatatta

SEQ ID NO: 386970 - DNA, 4166 bp, Homo sapiens
ttctgagaaggataaggagacctctcaccttggggctgggcctgaaccagggaggggctgaagaaaatcagcaagctggttcccctcagggcctcaagggacctctgcctgaggaatcagcatttggctttgtaagcaccaggagtactcctggaagctccagggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtctccgaattcaatcctttgacgttcaccagcgtgatcgaatgcgagaagccaaacaacgacctgagtaggtttcgcggctgcatcatacatgacaacgggaaaaaggccgggctgtataaagaaaacctgctgctgaggggctgcacccttaggaacacggacgcagtcgtcggcattgtcatctacgcaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggacatggactgtggatatggcggtatcaagagaagaagtcattattttatgtccccaagtctgatggaagctccttatccccagtcacagctgcagtttactcatttttaacaatgataatagttctgcaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatgcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcagttgacgccagagggaggcatcaaaaaaagattcggagcaaaactcagaattacctcaacgtgtatgcggcggaaggcctgcgcaccttgtgcatcgccaagagagttctgagtaaagaagagtatgcctgctggttgcaaagccacctagaagccgaatcctccctggaaaacagcgaggagctcctcttccagtctgccattcgcctggagaccaacctgcacttgttaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggtgatggagccaatgatgtcagcatgatccaggtggcagatgtgggtgtgggaatctccggccaggagggtatgcaggcagtgatggccagcgactttgcagtgccgaaattccgatacctggagaggctcttgattcttcacgggcattggtgctactcccgacttgccaacatggtgctgtacttcttctacaaaaacacaatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggaataccggccacgaacgttctggtttaacatggccgacgccgccttccagagcctggtttgcttttccattccttacctggcctactatgactcgaacgtggacctgtttacctgggggacccctattgtgacaatcgcgctgctcactttcctgctccacctgggcattgaaaccaaaacctgggtaagagccgctgcatggccacttctcagaagagcactgatgccgtggaccccacacttcctgcagattcatgaggtcggggaggccgtttgagtagacaggagactgcaaagctgacctcagtgtgatgagaaggacaatgacacattcccgagccctgtggtgtggggagccgctgcagcctgatgctcgcacttccccggccatgctcatctccc

SEQ ID NO: 386971 - DNA, 414 bp, Homo sapiens
aatgactcctttcaatcatctccattgccccaaataggaaagaagtggcaatgttaaaactgtctctcagcccattttccccagtgttttccttccagttaaatgccatcaatttgtatagaagtatcatatcaagaggaaagagggatattcagagaaataaaacccagaagaattactgccatataaattcttaaacctaaaaacatgacatagtggagtcacaaaactgaggtcctaccctcatttgccattcaccatgtgaccaagtaaagttgctgaacttctctggacatggtactttcctaagagcaaagtaaattatacttctgaatattcatttcaattcaactcatttgtagcatacagaataaaaagtcagatcaaccggttgggtaggcagcaaaagttagt

SEQ ID NO: 386972 - DNA, 381 bp, Homo sapiens
gactaatcacatgacgtgctttaaaatatcttgtcctaacacatttcactttcctcgacatttcttactctattttctgaagatatgtacttttatatgaatagggagttattctagaataaaagctccatgaagataagaattttgactgctttcttctttgctgagtgtgcaatgcctagaacagtgcttgagaacaaactgtactcaatgaatatgagtattttgagtgaatgaataaatgaatttcatagaaaaaatgacatattccatatccattgcttcctctttacttctgaaatagcttctcaactgtgtctattttatatcccctaaattaaattgcacagacatgctacagccagatggggcttcctcaca

SEQ ID NO: 386973 - DNA, 395 bp, Homo sapiens
gccatcagaacagtacctggcccaagggaggctatggaagtgcttgttgaataaaaaaatggcttcatctctggcctagccccaaaggtttgagttcctgccattgccacccagacagccctgggtggaggccctgctgacattgaagagtgcctgccctcctcccctcaatgcggtagacactttccaaaacttacgtcatcctcactctcactccagtgggataatgggaggcttggtgtacctcattcccaagatgagggaacaggctctgagaggaccacatcgccagcaagtgacaggctgggaccaaggccaggcctgtctgcctcctagactaggcctgagtgaggaccggcctgagtacggcccacctgcttcctcctccgtttaga

SEQ ID NO: 386974 - DNA, 406 bp, Homo sapiens
aaaaagggaagaaaaaaacctatgattttgttaaaataaaaggtcagatagcaaaagtaattcagcacaaactctggatcatttagtcttagcaatcttctactgtgaggagttttagaacgtaactccatactcacaaagtagaagctagattttttcaaaccaagcaactagttagacagaggtagaaacaaaacccttggcttcaaaataatcccagaaatactcttctcaccaagcgagtcttatagcatctgatgtgtaaaaatcttttttttaaagtaaaaattattcatttcttaactgaaatgttttaagggtaagaagaaaaaatataaaataatttaaaataggggtagtaaaacattttaagttgtttctatttctgttcagtatactctcgagt

SEQ ID NO: 386975 - DNA, 552 bp, Homo sapiens
gcgttcatatacaagttttggtaccattaagtatttttgggaatgacagtatagcaacaaagacctgtcttaggtttgtataatttggaaagcacttttcattcgatcatcccaatttcagcacctaaacactgctagaaaacttgccggtgagtggcagttttcccactcagttctcatattcttctcactacacactgctctcactttccccgccactgggtagtgttttgactgtgataattacgagtgatgttcaaagaaaaggaaagttggctgggcacagtggctcacgcctgtaatcccagcattttgggaggccgagggaggcggatcacctgaggttgggagttcaagaccagcctgatgaacatagaaaaaccccgtctctactaaaaatataaaattagctgggagtgggggtgcatgcctgtaatcccagctacttgggagactgaggcaggagaatcgcttgaacgcataaggcagaggttgctgtgagccgagattgcgccactgcactccagcatgggcaacaagagtgaaactcca

SEQ ID NO: 386976 - DNA, 280 bp, Homo sapiens
ttgttttctagatgctactttggagtcatgtaaatattttctgtgattgtaaaacaaaaattttaaataaaaactcctaaaaatcaaaaataaaatgtgacaaatgaaccctgcatttataaggtggtagcataaccacacagagaagaatgactgacagtgaaatacattaatcctatatccgtagtgggacataaactaatgacaaaagaaaaatggtggtattggtgctggcattagtagtctgaactgctgtgtatatcaaagcaagtaagtaatt

SEQ ID NO: 386977 - DNA, 99 bp, Homo sapiens
aaatactgtatttataaataaatactgtatttataaataaatactgtaaatactatttacatagtaataaataaagaactccaaatactagtctaacct

SEQ ID NO: 386978 - DNA, 284 bp, Homo sapiens
aatggatttttcttcaagcttagcttctccttcctaatttgcttgcattcttaatttttttagagctctcaagtagttgcagtttatgttttgtccactattttcagttgtaatccatgagagacagtggctgtagtggacttgttccctcttggctagcaataggagttctctgtatctatgcacgtttgtattgattcttcatagctcacagtgtctgtcacctaggtgatgagcaaaacgtatgtattgagtgaaaggatgaatgaatagacaaaggaatg

SEQ ID NO: 386979 - DNA, 344 bp, Homo sapiens
agtggtagccactctttaagacagctatcacttaggtttatgtttatattaatactacatcagtaagtatatgctagggactagcacatccttaccttgaatctataatgaggaaccttaacccctctttgctttggctctgcttgtctatatttagtcatgaatttttggcaaggctttttatacttgttccatttttctcaatgtcatagtgtatcagaagtgtgttatggatgtggaaataatgcagatcacacttggacacttttactaatatacttaacctctgaatgtcattttcctttactgaaattgaagaaaataacgtctttattctgatattt

SEQ ID NO: 386980 - DNA, 656 bp, Homo sapiens
ttgggaagaatctcttatatatatccacaaaattagaatgtaatagggtgaggccaaatggaatattggagaatcagttttcatttgttccacggcaccccatctttcctgtgatacccgtgaaacggttgcacaatacttataagctggtgctggggcactctgtcttccttcttcctgccaaatgcatggaggtgatcctgtctcaccaaaagtcctatagacagggacaaatgaacttctgcccattgttctcccagaagagcggcacccaccacgaatgctccatttcacctcatgtctagttcacctaatggcctagttctgggtttatttatatttacatattcaaggagtacatattgaacacttactaggtgcaagacaccctgatagtcccattacggaagttccaaaagaatagtttataggtatttctgtttaatcaatcctttttatttagaaagatataaaaatgacttacattattccacattccatgaaatatttccactttattcagcataaatgacattaataggctaacataagctctaaatgttataaataaaacagagccccaacactgttttattaaaactaccaaaagcccattaaaatcatgaggaaaaatgaatactttttgtgagttaaaa

SEQ ID NO: 386981 - DNA, 599 bp, Homo sapiens
cagaacccgccctgccagtacagagggcccactggatttattgaaaaaaacccacatataaatggacctgtgcagtccaaacccatgctgttcaagggtcaactgtagtacataagatctgataatctggcagtcaggtggtgagggttgatgatcagccacatttatcaagggggttaagatttaagagcaatttaaaagggccaggtctcagacctgtgcaaggccacgagttagaaagtgagactatccctgagtaaaaccaggacacttaagtaaatacatcctcagtaaaacaatatatagaatgtgaaaaattcacccactagcaagcagagaagaaaaggaatattgtcatttttaactgcgcttctagtgaggaaaaggagtctctcctaagaatttgtcatcataagctttggaatttgggcttcattatactacctacatagactgagaaatcctaaattaaaagtggtactctcctaatattgtgtggtgcttggaagaaacaaaaaaatcttttcggaaccacatactcttaacctaggcaacccataattcccacagataaaagcattgcaaacacaagcttttaa

SEQ ID NO: 386982 - DNA, 447 bp, Homo sapiens
agagatggggttacaccatgttagccaggctggtcttgaactcctgacctcaggtgatccacccacctcggcctcccaaagtgctgggattacaggtgtgagccactccatctggcctgggatgcccatatgttctaatcttaccttgaagatttcttgacccagacctagagtcttcatttctcttaggagacttggttctttgtattacaaaattgtatttagagaccataatctgagtcatatggggttctcattgatactgtattggacatcagtcttggttttttccatggctagtttagctcttctcttactcagaaacttggaaaatacagagaagcaaacagcttgctggattatgtagcaccacttcagctgatgagtaccagaatgccagtttcctaatttggaataggagctctacctgatacttgggccagtcag

SEQ ID NO: 386983 - DNA, 660 bp, Homo sapiens
ggtttataggtcccggcccgagcctccggccgcccgccgggtttgtcccgcgatccccgaccatgcccgccgacctcagcggtacttggaccctgctcagcagcgacaacttcgagggctacatgctggccctaggtattgactttgccactcgtaaaatagccaagttgctgaagccacagaaagtgattgagcagaatggggattcttttaccatccacacgaacagcagcctaaggaactactttgtgaaatttaaagttggagaagaatttgatgaagataacagaggcctggacaacagaaaatgcaagagtttggttatctgggacaatgacaggctcacctgtatccagaagggagaaaagaagaacagaggctggacccattggatcgaaggagacaaactccacctggaaatgttctgtgaaggtcaagtgtgcaaacagacattccagagagcctgatccacatccagcagcagagcccacttgtggctgcagctttatgccaaattatattgcagactgaacagacgtttatctatcccatttggcgacgaggactcgtggctggagagagccacacagcgtgtaacctgaagtcatctagattatggggaaactgctcagcttcaataaacctgtccaaatgacaaaa

SEQ ID NO: 386984 - DNA, 556 bp, Homo sapiens
  misc_feature (325)..(325): n is a, c, g, or t
  misc_feature (330)..(330): n is a, c, g, or t
  misc_feature (347)..(347): n is a, c, g, or t
  misc_feature (349)..(349): n is a, c, g, or t
  misc_feature (368)..(368): n is a, c, g, or t
  misc_feature (375)..(375): n is a, c, g, or t
  misc_feature (438)..(438): n is a, c, g, or t
  misc_feature (479)..(479): n is a, c, g, or t
  misc_feature (481)..(481): n is a, c, g, or t
  misc_feature (490)..(490): n is a, c, g, or t
ttgggcctgcattcaggggctgtttctaggggaaactgtgactgagaaagcgctttgggggggcgagctctgggctgagtgcccctgttcaagggctggaggaggctcctgcttcctccctcaaggatgctcttcaagtgtggggagctcccaggggagagcccaggggcttcctctttccccacaggtcagagagggcttggggggagacaagtggagctgggtaggggtcccttggggcagtggggcacaggtggacggggcttgcctccttttaggtgagatagatccacacacacacacacacacacacacacacttctgnctcanatgcacagctgtcttcngnataaaaattcttctatcantggccanttactcttgggcattagcccccaagttaccgaatccaatctactcagctccctgacacttgtngggactcgggtctcctaggtcgtgccatcctataaaatcgngncattctatnactctgattgggtaaaagaagcaactctgcacatccctgaggggagcccaaggggtaccgagctcg

SEQ ID NO: 386985 - DNA, 679 bp, Homo sapiens
ggagatggatcttgcagtaagctgagatcgcgccactgcactccagcgtgggcaacacagtgagactctgtctcaaaaagaaaaaaaaaaaagaaaattgtcaaaacacaaccaatagataatgttaacatgcattctaacatgcaatttattggatttagcgaatagaatgtgagtggaagttacttttggtagaactgttgggaaaagggcttgtggagtgcctgcataaactggccataaaaatatgggacaataagttgtggaaagccacaagaggcctctgaggaggaaagcctcctaattgccatcacgttcctatgaccagagtgtgacctgctctcttatctataaacactgtgctcaaggagaaagacactcctttgaagcattggaatgtggccagatatgctggcttctagttaggcccactccccacagctgctctctgataagtaaaagaataaatcagtagttaagtttatgctgcttcagcacaaagaaaatgtacctaaactgccattgcccccctttcactgtttcacccctgaacatctgcttcttagatctaagtgattgtactcaataaatagtgtggagaccagagcttggcgcctttgcagcttttgatttgctctggccccttggctcccacctttatgaactcttaacctgtctc

SEQ ID NO: 386986 - DNA, 839 bp, Homo sapiens
attctggactttgagctcaatgccatgactgaggaagaccacggggttttctctcttagaggggagggctcagtaaacacttaaggaagttgccgtgcactgcagcctgccggagacatgaaggaatgtacgggaggataatcgcaacatcatcaacccaattctccaagtaatttgccatgggacaggcacaccccatgtgtttgggaagacaatgggaaggttctgttttctgctccaagactgattcaaccagttggatctggaaggggataaagggctgtgtggctgcttgattttcattgtctagtggcagccaaaattggaaaagagagaagtgcagactttaaagacaagcagcgacagctcatcagcagtctaacaacacgacagatgacaggcccagaggcacacccagggccgccagcccatcaccctgtgcaggatgtcaaagagcagctgcagcaaaggaagaagatcatccagacttaaatgtttgggccttgctaagaccatagagtctttgtgctttggaaacagtcctccatacaaagaccccttcctagaaaagagtggaaagaaaccaaggtggaatggatacaacagaaaggagaccatgctaatattcttgtgcaatgcttcctgggcagaaattatgtcataaaggatgttccattctgcaaagctatgtgtctctctgtggtttgcctcagaggaggggcctttcatagctgtagtgagtaagggggcccttgctgatgttcatcagatattgccaaggcacaggaagaaagcattgaggtcacagggcagctcaggtccgcctgtggtaattgaaa

SEQ ID NO: 386987 - DNA, 883 bp, Homo sapiens
attctggactttgagctcaatgccatgactgaggaagaccacggggttttctctcttagaggggaggaatccttgatattcttcattccaattgttcacctctactgtagggctcagtaaacacttaaggaagttgccgtgcactgcagcctgccggagacatgaaggaatgtacgggaggataatcgcaacatcatcaacccaattctccaagtaatttgccatgggacaggcacaccccatgtgtttgggaagacaatgggaaggttctgttttctgctccaagactgattcaaccagttggatctggaaggggataaagggctgtgtggctgcttgattttcattgtctagtggcagccaaaattggaaaagagagaagtgcagactttaaagacaagcagcgacagctcatcagcagtctaacaacacgacagatgacaggcccagaggcacacccagggccgccagcccatcaccctgtgcaggatgtcaaagagcagctgcagcaaaggaagaagatcatccagacttaaatgtttgggccttgctaagaccatagagtctttgtgctttggaaacagtcctccatacaaagaccccttcctagaaaagagtggaaagaaaccaaggtggaatggatacaacagaaaggagaccatgctaatattcttgtgcaatgcttcctgggcagaaattatgtcataaaggatgttccattctgcaaagctatgtgtctctctgtggtttgcctcagaggaggggcctttcatagctgtagtgagtaagggggcccttgctgatgttcatcagatattgccaaggcacaggaagaaagcattgaggtcacagggcagctcaggtccgcctgtggtaattgaaa

SEQ ID NO: 386988 - DNA, 397 bp, Homo sapiens
tcaaacacattctaattctgattttttttaacagtaatttgccatgggacaggcacaccccatgtgtttgggaagacaatgggaaggttctgttttctgctccaagactgattcaaccagttggatctggaaggggataaagggctgtgtggctgcttgattttcattgtctagtggcagccaaaattggaaaagagagaagtgcagactttaaagacaagcagcgacagctcatcagcagtctaacaacacgacagatgacaggcccagaggcacacccagggccgccagcccatcaccctgtgcaggatgtcaaagagcagctgcagcaaaggaagaagatcatccagacttaaatgtttgggccttgctaagaccatagagtctttgtgctttg

SEQ ID NO: 386989 - DNA, 484 bp, Homo sapiens
tgtagcctcagtggtaatgcaaaataaactctcaatgtccttatagctgaagtagtgggcgcctgtgcactcttaaataaaacatgctgtttctggatcaacacttccagtcaggtagagaaaaatttacaagtccttaaaaaccaaattgaaatcactaacaaattaagggaaaatgcaaactcccgtcccagttggctacaatccctttttaataaattcgagtcttggttttgggcctggttagctcccctacgaaaacctcttttccttatatgttttatattagtgtttggcctttgcatactcaatgatataacccaaattgtttcctttcccgaggggctaacaagcaccaaatggtaatgcaaataaaaccacacatggatgtgcctttcttccgcggacccttaaaccaaccccaggaggaaccctagctgctcttcccccacacaatgcccctttccagcaggaagtagccaaa

SEQ ID NO: 386990 - DNA, 2120 bp, Homo sapiens
  misc_feature (1811)..(1811): n is a, c, g, or t
gcagccgccgcggtcgggctgccccctcccctcgccccgaccgctcccctgctggtgagggcctgcgcaggcggcggcggcggcgcccttggtggcagtggtggcggcggagcagcctcccgggatcgtgtctggagctcgaggagagggtagtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggcggtgaaagggatctacctggacaccgcagatgaagacttctatgctcggtttgctaccgggtgtgtctccatcccctggcagaatgagatgatcgaatcngggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 386991 - DNA, 2024 bp, Homo sapiens
  misc_feature (1715)..(1715): n is a, c, g, or t
gcagccgccgcggtcgggctgccccctcccctcgccccgaccgctcccctgctggtgagggcctgcgcaggcggcggcggcggcgcccttggtggcagtggtggcggcggagcagcctcccgggatcgtgtctggagctcgaggagagggtagtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggcggtgaaagggatctacctggacaccgcagatgaagacttctatgctcggtttgctaccgggtgtgtctccatcccctggcagaatgagatgatcgaatcngggtgtttcaaagacatcaacaaaagtgaaagtgaggaagctttgccattagatctagacaagaacatacataccccggtttccagaccaaacagaggcttcttctatagactcttcagaagagggggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 386992 - DNA, 1886 bp, Homo sapiens
gcagccgccgcggtcgggctgccccctcccctcgccccgaccgctcccctgctggtgagggcctgcgcaggcggcggcggcggcgcccttggtggcagtggtggcggcggagcagcctcccgggatcgtgtctggagctcgaggagagggtagtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaagaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggcggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 386993 - DNA, 1982 bp, Homo sapiens
gcagccgccgcggtcgggctgccccctcccctcgccccgaccgctcccctgctggtgagggcctgcgcaggcggcggcggcggcgcccttggtggcagtggtggcggcggagcagcctcccgggatcgtgtctggagctcgaggagagggtagtgcccggcgagctatgcacgggggcggcggcgtctcctcctgttccgcctcctcagtctcctcggtctcgcagaatccgccggcggcggcggcgccaggacatggagctcgagaacatcgtggccaactcgctgctgctgaaagcgcgtcaaggaggatatggcaaaaaaagtggtcgtagtaaaaaatggaaggagatactgacactgcctcctgtcagccagtgcagtgagcttagacattccattgaaaaggattatagcagtctttgtgacaagcaaccgataggaagacgtctcttcaggcagttctgtgataccaaacccactctaaagaggcacattgaattcttggatgcagtggcagaatatgaagttgccgatgatgaggaccgaagtgattgtggactgtcaatcttagatagattcttcaatgataagttggcagcccctttaccagaaatacctccagatgttgtgacagaatgtagattgggactgaaggaggagaacccttccaaaaaagcctttgaggaatgtactagagttgcccataactacctaagaggggaaccatttgaagaataccaagaaagctcatatttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaaaaaaaagaataaagaagaggaaaggtgaagctatggctctaaatgagaaaagaattctggagaaagtgcaaagtagattcgtagttagtttagcctacgcttatgaaaccaaagatgccttgtgcttggtgctcaccattatgaatggaggggatttgaagtttcacatttacaacctgggcaatcccggctttgatgagcagagagccgttttctatgctgcagagctgtgttgcggcttggaagatttacagagggaaagaattgtatacagagacttgaagcctgagaatattctccttgatgatcgtggacacatccggatttcagacctcggtttggccacagagatcccagaaggacagagggttcgaggaagagttggaacagtcggctacatggcacctgaagttgtcaataatgaaaagtatacgtttagtcccgattggtggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgttactcaccaagaatccaagcaagcggctgggctgcaggggcgagggagcggctggggtgaagcagcaccccgtgttcaaggacatcaacttcaggaggctggaggcaaacatgctggagccccctttctgtcctgatcctcatgccgtttactgtaaggacgtcctggatatcgagcagttctcggcggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacaaaaaaa

SEQ ID NO: 386994 - DNA, 333 bp, Homo sapiens
ttttttttgctcccttctcaatctaagaatgacaggaattatcagtaatgatgtagtgtagatcaggaatccccaacccccaggccatggatgggtggggtattggtccagggtctgttaggaacccggccgcacaacaggagtgagtggcaggtgagtgagcattaccacccgagctctgcctcctatcagatcagtggcgacattagattctcataggagcacgaaccctattgtgaaccgcacacacaaggccagctccttatgagactctcatgcctgatgatctgtcactgtctcccatcacccacagatgggaccatctagttgcag

SEQ ID NO: 386995 - DNA, 430 bp, Homo sapiens
gacggaagcacccctccaagcctgccaataggcctcctccagagggcacagcccagctgcctctgctgtggggtggagctctcaaggcctagtggcagccctgtaaattgttaactaaataagtagatctttgagcagaagagaggggagtgcaaaggaccctgctcctgagctggtaaggaatgtcagacgaaacaagcttttcaaaaagacacttccattcactctaaacctacaagaaagccagagtgacagggccatttatttgcagaagagctggggagggggtggaaagggaagcagagataaggagaaggagcagagaaataagtaaaggagggaaaggcagggagagagagagaaggttcgcaaagcatgcagagagagggagacagagaaggagagggggcaggctctaccccagggtcca

SEQ ID NO: 386996 - DNA, 440 bp, Homo sapiens
aaggtgctatcagccttgcaccaggccactgctgtcatgtcttatttggagtatttcagtaagcacctcactactatccttgacttcagtttctttctctccagtctaatatgtgtgaagcacggttctgactatatcccttgcaagctgaaaaagcctttgctggtttccttttcttacaaaataaagtccagcctccttaacaagggattcaaggtcctctgtaatctcctcttatctgtctttcgtccctagtctcccttcgccctacgctttcaacatgcatactgtattataggcatagctgtgttttacattttcctgcttttgtgtctttgcctggagttttctttggcctggaattttctcccatccaatttctgctcttcagaggatcccttgttcttcaaagtctagttcaggcatcacctttccctcag

SEQ ID NO: 386997 - DNA, 598 bp, Homo sapiens
ctgctggtgggaagagccgtggtaaggtgtctcctttctttcactccggagcgggggtgatgacaggagagggaccgggcaggagcgaagtgatgatggtgataatgggggtaactgctgagagcgggagagtgggggccaggaacaggaggagtgtgagcgtgagaagacagtgctcagaagccgacacccaggtgacttctctggaatctccctgctctgaaatgggtaacgtggctcctttctctgaagctccaacacttaaaggagcttcttgttttaagcttcttgtgttaagctccagatttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaac

SEQ ID NO: 386998 - DNA, 544 bp, Homo sapiens
ggtttttttttttacaagtgtgctagttattttcatagttttgaaatttcagtattgtttcttgttaaggaaatacttttcagtaaacttgttctgaatataattcttgtggaatacttaagttggctaacctaaatatcgaaaggttctgaacatgcgtattatgtgaacagaactgtatttaaaatttgaaagcagaaagtaagatgtattgaaggaattgtgatgtttgtaatttacaagaagcttgagcacgtgtcgggagcacagtgggaataatacaaagggtatcatcttttgtaacattaatgttaaagtttgggatatttgttcacatgaaacattgtgtttattttccttgtcttggcttttcacggtggctcatgcctgtaatcccagcactttgggaggccgaggcgggtggatcacttgaagtcaggaggctgaggcaggagaatcacttgaaccccagaggtggaggtgacagtgagccaagattgcgccattgcaccccagtctgggccacaagtgggaaacttcgtct

SEQ ID NO: 386999 - DNA, 563 bp, Homo sapiens
tttaaatgtacttatactgcaagtcacctgtaattacgtatcctgctacttgtatcctaagaaatctagaagcccactgaagaacttgcctcaatttattaaaataaaatcattatcttggagtatacactctgcattcccatattctttattctagatgtctggagaattatgaaatcatttcctgaatacttacattctattaatttagggtacattttttccaaagacagaatgtaaccagttgtatagtatttatgacaaaaacattaagaaataacagccgagcgcaatggctcacgcctgtaatcccagaactttcggaggctaaggagggcagatcacctgaggtcaggagtttgagaccggcatggctaacatggcaaaaccacatctctactaaaaatacaaaaattagccaggtgtgggggcacaggcctataaccccagctactcaagaaactgaggcacaagaattgcttgaacccggggggcagaagttgcagtgagcccagattgccccactccactccagcctgggtgacagagcaagattccatttc

SEQ ID NO: 387000 - DNA, 244 bp, Homo sapiens
gttgttgttgttgctgttgttgttatggctaccattatttcttatctggctttaaactatagatcactttattttatacttttttagtatttgcataatgatgtaaaatacctgcaggaattaacgaatcaaatgtcctcttatattgccagcttcttggcgatatactaggtttgtaagtaaactatttcaacatctaaacttttatactaacaaggagttcaatattatacctaaatttgtg

SEQ ID NO: 387001 - DNA, 132 bp, Homo sapiens
cctgggctgtgtggttctcagaatgagccacctggaaggtcgatccaagtacatgaagattggattttctggtgtccagagtaacctcttcactttgggtctctggcaggcccctattccctttatggattt

SEQ ID NO: 387002 - DNA, 533 bp, Homo sapiens
tccagttgaaaaatcattaacaaaaaagtgtaagagtgcctaaataccagaatgtagattttttaagtaatgaaagtacttgctatgaaactgtggcaaatgcttaatcgttttatataatatgttcctaatgaatttaaattattttatggaatgcattctcagtcagatattttagcacacagaacttgagtcagatgtttgtattaaacataactgccttcaggtgaaaatgtggtcagtgaattacatctcccacaatgcagaacatccgtgcttcatagattgcagaatagctacagatagtgttgaagcataatttagaattcaaatgctaccactgagaggtaggaattcacttgtgaaaaatatttgaaagaaatacagtaaaattttattaatttaggtttgaacaatttagaattgttaattattcagtgaggttgaattcagatgaagttaacagtataccttagttagtgaagtaaaaagcttcccaagcatacatgtagaagaactcaaaagggacacag

SEQ ID NO: 387003 - DNA, 960 bp, Homo sapiens
aaagcaaaaagttcccagaacgtttttgcttagattttgttctaatcaccacgtgaaggaatgagattagcaccacaagtttcatgccaataaaagagactggtgtgatcccacatgcaaaatttaatcctaagggtagtgagatcacaaacagaataaaaataagagcaatcaaccatataaatcaagtacctattgggaacagacataacattcaatttttcatttatgctaagtgaccacagtatacaaagtaataagcaggaaatttgatatgggttaaattatgcattttgttcagattttggaaattggtatgcattataagtttctcaatgtacatctttttatcccaacaccctcaaactagaatatttgtcagtggtcaagagaaaaaattttacctgaattcttgggggccggcggggagcttttacattaaaaatctactaacgcctactttttaaaaaatgagattctttctaatctttatatatgacattttctagacaatcgcacctttgggtatattaaacagctggtatcataacaaagaatccaaatgaaccttcaatatactagaagttctagtaggttaatattgttcagaagatttttacaaattaaaaactgatttccaaatatgttcaacatttacttctatttgatatctgctcaagaagtcatagaagtcttgggaaactattcgagtatcacagaggttttcaaaagcccttatggtgacatctacctaggtaaaagcctgacatgtggctttataattgttatgttacccaagggataaacttgaactggctttgaacatcctttaggtcattttctctttggataattttcatcgcatatccagcaactatagacccaaagtttgcttaaggtttgaccctagagcagaggtgggcaaactatgacctggaaaccaaatctgacttaccacct

SEQ ID NO: 387004 - DNA, 917 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcacagtaagtgtattggccattcttgggccttctgttttctccgttgaccctgccagatttttttactgatgcagaaatgatggctactggtgagcctgtttatgagaaatgcaaataaacattccaatgtgtagaaaagtcagatgctttatatctgtgttcttgtatagacagaaaaatcatggagaagccagcagttaaacatggagaaagcctttccatgagaagggggctctagtgtccagccagaacatgtggctcagactccagagagataacaaattgacatttgggccaagccaaagagctggcgaggggagggggtgggtgcttccattgcacaatgttaagtgcaaatcttgactctgccttccattagctgtgtgatagcagggga

SEQ ID NO: 387005 - DNA, 4233 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387006 - DNA, 3477 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtccaaaacacaaaaccacaacacaccaccaacaacatg

SEQ ID NO: 387007 - DNA, 4180 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagatgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387008 - DNA, 4184 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaaaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387009 - DNA, 4179 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaatcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387010 - DNA, 1554 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatggtatgattctaattacagtcagcgtggggtcagttctgctcattctgaaaatccatatttgggggctgaaaatgaaccattactgaaatgaattggggagctatcttttttaaatgggaagtaactctcacacttctgtgctgatctctgtttaatggctagaaagaagagtaacaatcctcctgatcacttctcacacattgtcagtgtctca

SEQ ID NO: 387011 - DNA, 4189 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387012 - DNA, 3121 bp, Homo sapiens
attttatggtattattaacaacaataattaatgtccacaaattttaagatcaatcaaaagacaaaaaaaattattcatcctttctggaatgttaatatagcatttaaaatctggcaaacacctcccccattgtaaactaagatagcattgccagatctcagtgtttttttctatcatcaatagcatgatttttgcagtaatacattcatcttaatattttctgtttagatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387013 - DNA, 2128 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387014 - DNA, 4179 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387015 - DNA, 4179 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387016 - DNA, 4185 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggctgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387017 - DNA, 4174 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387018 - DNA, 4159 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387019 - DNA, 4223 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcaccctcgggaaaggcacaaaacccgggaaaaggagccctacccaaatcctccggctatccagagctgtcacatactttagaccagggcctttgtgacaaaccccaaccaatgggtcttgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387020 - DNA, 2607 bp, Homo sapiens
tgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtctactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaagtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagatttt

SEQ ID NO: 387021 - DNA, 6709 bp, Homo sapiens
agcccacccgcctggctgcgcgtcccgggcccggcggctgaagaggagccgcggcgaggaacaagagtgtggtgagaggacgcggaaacacctgatatcccagcaaaggaagctgcagaggaagggtcctgccccgtgagcgaggacagcctccaggagcacagcggcttctcctaacatccccctggcagtgaattacggatgaccccgtatatgaggaggtgtggatgccgacacacggggagagctcctgagaccagcacacaggaccagtgtcctccccgtgaccttgcagttgtgtagccacaagtgggagccacagagaaggagagcccataaggggactcttttcaagacacggtgttaaatcaaggctctgaagttggggccacagccggtctcagctttctgtgttctgggggcgcggtgatatgacagcatgtgaagtgagtgggtgagcacggactcctgagagcgagggcgcacccaatacctagttatccggtactgcagagagacacctggtcagccagcgttgcaaagagggatagctagtcactcaggctgcagagagagacacctggtcacccaggctgcagaaacaaccgcagtcaactgcagctccagtcattgctggatgttggctgacgcggtcctggcgccagctggagatccattcaccaagactttctgggcagatttaaagtggctggggttcagaagttcagcaagttggacacacccctcctcgctggagaggagagggcaaaggcgaggcgggggagcagcgtgtgagattccccccttcacacacacaacaacaaagcgtggacacacagaagtgaaatctgatcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcgctttgctttccttttgcttgtctttgcttctgggggtggatgccttgagacccaggaggtgtgcggatgggtcccttgacagacaggacacagagaaggctgtgggatccaaagggtcagcctcagggtacagtgggggttcctgaggcagcctgcagccggccccggggtgtcccgaaccccgcagagcaccgaggctgtgcgcaggagcctgggaccctcaagtaggtcgccgcgaactatcgggggaagcacgcagagaggggtcacgccttttatttttggcttgagatttaaaattataactgataagtaaagctctttctgatttagttgaaaatttcgtaccatgtgctcgctttggttggctcaactccaaaaagagtaatttaataagcattaaaggtaaaatctttgattaccagtaaggtttcttgttcaatatgcattggaagtatttccttccccacaccattgctactcaaactcacatgcctagagcagctccgtctcactgttggaccgagggggctttcatattttcagttgaaaggatgttaactgatgtagcgatgatttaccattatttaaattttaagtcttcagtggctaaatgtgaccaaacagcacatcataagtaggaaaaacttaccagggtgcttgtctatctaaaaagcaatttttgatagtccactctgtatgcccagccgctttcataatctggaacgagataaaatattcctaaaaagcggggaaaatcattttgctttgacagttctataaaaaaaagtgtaggcacattttaaacccactgtatatgatgttttcaatgtggatcgtgtagttctgatgagggagattaatttttacaatcagtattctaagtgtggccgagtgacagtgggcatagatttataacaaggaagtgacgtgcttatcaccatagatttgcaagtaaactgcatgtatttaattgtattgaattgagttccaaaataccctaatagaattaacacgaggctcactgcattgacagggtatgaggattaaaaacaaatcagttgggtcgtttctcatttaacattttacttttcaagtgtgtatacagaggacttactattatgactttgaggatgagatccatgctcacaaatagaggcgaacatttgaactccgaatccaacccattttcttactgtaagaggaaaagttactggaacgtaactagttgaaatcctgcctactttaatattatttgtttgttaatccagtaatgggaactgccatctctgtagaaatcagtgggtaattgaaaaataggttatgctttttaaagagtctgtggttatgagaggtctcagttaagtgtgtttagaagtgatcagcttgaaccttatgcatgactcgggggctggaatttatgatctgggttacggtatgttctggggacgtgtctgcttgcccatggttactcatgaactgaggggatagcttggcaacttggttaatcatcttgggaaagaaaaacagacttcatatcgcctgacttgattggccttttataggagtatactggagaaatggttgtagaaacagtatttacagcaaaaggaaacaaataatgttcattttaagcaatgtaccattcacactgtcctgccttttcctctagaattttattaatggtagaaatttttatatgaaatgggaccaggaccaggctaatattttcagtccttaaatatcaaactcatatgctgttatcactgtgattttacttgtgaaatcattcctgtaatgtttagtgtttgaaaatgaaatattgaaattaggtttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccaagccatgagcagtgtttttgctttttgggggccagtccctggggtgtggagccgctagggtttgcacccatgaaacagaaaagccacaccctccaaggtgtggctttcattttgggactgctgcagggagggcagaggcattgctgagactgcctggcaacggctgatgccccaggtaggaccttttccatttcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctcctgtaagaaaatgaatgttgtggaaattctttggctacttaactaaaactcgtgactgtataagtttggctacaaataagtaagaaattaatcatctgctctgtttctgctaatttctggtgtcacttcagtaattctggtagcagccgttgaatctgtcagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctatttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtc

SEQ ID NO: 387022 - DNA, 7192 bp, Homo sapiens
agcccacccgcctggctgcgcgtcccgggcccggcggctgaagaggagccgcggcgaggaacaagagtgtggtgagaggacgcggaaacacctgatatcccagcaaaggaagctgcagaggaagggtcctgccccgtgagcgaggacagcctccaggagcacagcggcttctcctaacatccccctggcagtgaattacggatgaccccgtatatgaggaggtgtggatgccgacacacggggagagctcctgagaccagcacacaggaccagtgtcctccccgtgaccttgcagttgtgtagccacaagtgggagccacagagaaggagagcccataaggggactcttttcaagacacggtgttaaatcaaggctctgaagttggggccacagccggtctcagctttctgtgttctgggggcgcggtgatatgacagcatgtgaagtgagtgggtgagcacggactcctgagagcgagggcgcacccaatacctagttatccggtactgcagagagacacctggtcagccagcgttgcaaagagggatagctagtcactcaggctgcagagagagacacctggtcacccaggctgcagaaacaaccgcagtcaactgcagctccagtcattgctggatgttggctgacgcggtcctggcgccagctggagatccattcaccaagactttctgggcagatttaaagtggctggggttcagaagttcagcaagttggacacacccctcctcgctggagaggagagggcaaaggcgaggcgggggagcagcgtgtgagattccccccttcacacacacaacaacaaagcgtggacacacagaagtgaaatctgatcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcgctttgctttccttttgcttgtctttgcttctgggggtggatgccttgagacccaggaggtgtgcggatgggtcccttgacagacaggacacagagaaggctgtgggatccaaagggtcagcctcagggtacagtgggggttcctgaggcagcctgcagccggccccggggtgtcccgaaccccgcagagcaccgaggctgtgcgcaggagcctgggaccctcaagtaggtcgccgcgaactatcgggggaagcacgcagagaggggtcacgccttttatttttggcttgagatttaaaattataactgataagtaaagctctttctgatttagttgaaaatttcgtaccatgtgctcgctttggttggctcaactccaaaaagagtaatttaataagcattaaaggtaaaatctttgattaccagtaaggtttcttgttcaatatgcattggaagtatttccttccccacaccattgctactcaaactcacatgcctagagcagctccgtctcactgttggaccgagggggctttcatattttcagttgaaaggatgttaactgatgtagcgatgatttaccattatttaaattttaagtcttcagtggctaaatgtgaccaaacagcacatcataagtaggaaaaacttaccagggtgcttgtctatctaaaaagcaatttttgatagtccactctgtatgcccagccgctttcataatctggaacgagataaaatattcctaaaaagcggggaaaatcattttgctttgacagttctataaaaaaaagtgtaggcacattttaaacccactgtatatgatgttttcaatgtggatcgtgtagttctgatgagggagattaatttttacaatcagtattctaagtgtggccgagtgacagtgggcatagatttataacaaggaagtgacgtgcttatcaccatagatttgcaagtaaactgcatgtatttaattgtattgaattgagttccaaaataccctaatagaattaacacgaggctcactgcattgacagggtatgaggattaaaaacaaatcagttgggtcgtttctcatttaacattttacttttcaagtgtgtatacagaggacttactattatgactttgaggatgagatccatgctcacaaatagaggcgaacatttgaactccgaatccaacccattttcttactgtaagaggaaaagttactggaacgtaactagttgaaatcctgcctactttaatattatttgtttgttaatccagtaatgggaactgccatctctgtagaaatcagtgggtaattgaaaaataggttatgctttttaaagagtctgtggttatgagaggtctcagttaagtgtgtttagaagtgatcagcttgaaccttatgcatgactcgggggctggaatttatgatctgggttacggtatgttctggggacgtgtctgcttgcccatggttactcatgaactgaggggatagcttggcaacttggttaatcatcttgggaaagaaaaacagacttcatatcgcctgacttgattggccttttataggagtatactggagaaatggttgtagaaacagtatttacagcaaaaggaaacaaataatgttcattttaagcaatgtaccattcacactgtcctgccttttcctctagaattttattaatggtagaaatttttatatgaaatgggaccaggaccaggctaatattttcagtccttaaatatcaaactcatatgctgttatcactgtgattttacttgtgaaatcattcctgtaatgtttagtgtttgaaaatgaaatattgaaattaggtttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccaagccatgagcagtgtttttgctttttgggggccagtccctggggtgtggagccgctagggtttgcacccatgaaacagaaaagccacaccctccaaggtgtggctttcattttgggactgctgcagggagggcagaggcattgctgagactgcctggcaacggctgatgccccaggtaggaccttttccatttcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctcctgtaagaaaatgaatgttgtggaaattctttggctacttaactaaaactcgtgactgtataagtttggctacaaataagtaagaaattaatcatctgctctgtttctgctaatttctggtgtcacttcagtaattctggtagcagccgttgaatctgtcagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctatttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtcaaaaaaaaaaaaaaaaaaaaaaaaaaaaaaaaaaaaaaggggggggcggaaaaatttcccccgggggggccatttaacctcttaccccagttttttggtacaaagagtgtgccgccctataagaggaagagcgcgtattataaaaaacaggaggcccggggccgcgcgtcggtttaaaccacagcgtgcggtcgagtcgggcaaaaaacgcgcccccagctgggggatatcctggtgggaaagacgaaacctctatctctgtgggggggggcggcactttagctcggcgcacaactctcccctcacagaaaatattagacggcttccagaggggtaatattacaacacattctctccaggttgtcttatcagggggggttcaacaccccagcacgtgcatataatgctcggctgtctggaacaagttgcgtggcttaccgagcgtctactaattttcgcgaacaatttttttcacgcggacga

SEQ ID NO: 387023 - DNA, 2506 bp, Homo sapiens
ccgaggcagccatggcttacatactttctcctgctacactctaagagtactcagaagctcagtattgctctgttatcactgtgattttacttgtgaaatcattcctgtaatgtttagtgtttgaaaatgaaatattgaaattaggtttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccaagccatgagcagtgtttttgctttttgggggccagtccctggggtgtggagccgctagggtttgcacccatgaaacagaaaagccacaccctccaaggtgtggctttcattttgggactgctgcagggagggcagaggcattgctgagactgcctggcaacggctgatgccccaggtaggaccttttccatttcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctcctgtaagaaaatgaatgttgtggaaattctttggctacttaactaaaactcgtgactgtataagtttggctacaaataagtaagaaattaatcatctgctctgtttctgctaatttctggtgtcacttcagtaattctggtagcagccgttgaatctgtcagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctatttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtcaaaaaaaaaaaaaaaaaaaaaaaaaaaaaaaaaaaaaaggggggggcggaaaaatttcccccgggggggccatttaacctcttaccccagttttttggtacaaagagtgtgccgccctataagaggaagagcgcgtattataaaaaacaggaggcccggggccgcgcgtcggtttaaaccacagcgtgcggtcgagtcgggcaaaaaacgcgcccccagctgggggatatcctggtgggaaagacgaaacctctatctctgtgggggggggcggcactttagctcggcgcacaactctcccctcacagaaaatattagacggcttccagaggggtaatattacaacacattctctccaggttgtcttatcagggggggttcaacaccccagcacgtgcatataatgctcggctgtctggaacaagttgcgtggcttaccgagcgtctactaattttcgcgaacaatttttttcacgcggacga

SEQ ID NO: 387024 - DNA, 2499 bp, Homo sapiens
atccttaattaaattaattcccccccccccctttttcagtccttaaatatcaaactcatatgctgttatcactgtgattttacttgtgaaatcattcctgtaatgtttagtgtttgaaaatgaaatattgaaattaggtttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccaagccatgagcagtgtttttgctttttgggggccagtccctggggtgtggagccgctagggtttgcacccatgaaacagaaaagccacaccctccaaggtgtggctttcattttgggactgctgcagggagggcagaggcattgctgagactgcctggcaacggctgatgccccaggtaggaccttttccatttcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctcctgtaagaaaatgaatgttgtggaaattctttggctacttaactaaaactcgtgactgtataagtttggctacaaataagtaagaaattaatcatctgctctgtttctgctaatttctggtgtcacttcagtaattctggtagcagccgttgaatctgtcagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctatttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtcaaaaaaaaaaaaaaaaaaaaaaaaaaaaaaaaaaaaaaggggggggcggaaaaatttcccccgggggggccatttaacctcttaccccagttttttggtacaaagagtgtgccgccctataagaggaagagcgcgtattataaaaaacaggaggcccggggccgcgcgtcggtttaaaccacagcgtgcggtcgagtcgggcaaaaaacgcgcccccagctgggggatatcctggtgggaaagacgaaacctctatctctgtgggggggggcggcactttagctcggcgcacaactctcccctcacagaaaatattagacggcttccagaggggtaatattacaacacattctctccaggttgtcttatcagggggggttcaacaccccagcacgtgcatataatgctcggctgtctggaacaagttgcgtggcttaccgagcgtctactaattttcgcgaacaatttttttcacgcggacga

SEQ ID NO: 387025 - DNA, 6238 bp, Homo sapiens
agcccacccgcctggctgcgcgtcccgggcccggcggctgaagaggagccgcggcgaggaacaagagtgtggtgagaggacgcggaaacacctgatatcccagcaaaggaagctgcagaggaagggtcctgccccgtgagcgaggacagcctccaggagcacagcggcttctcctaacatccccctggcagtgaattacggatgaccccgtatatgaggaggtgtggatgccgacacacggggagagctcctgagaccagcacacaggaccagtgtcctccccgtgaccttgcagttgtgtagccacaagtgggagccacagagaaggagagcccataaggggactcttttcaagacacggtgttaaatcaaggctctgaagttggggccacagccggtctcagctttctgtgttctgggggcgcggtgatatgacagcatgtgaagtgagtgggtgagcacggactcctgagagcgagggcgcacccaatacctagttatccggtactgcagagagacacctggtcagccagcgttgcaaagagggatagctagtcactcaggctgcagagagagacacctggtcacccaggctgcagaaacaaccgcagtcaactgcagctccagtcattgctggatgttggctgacgcggtcctggcgccagctggagatccattcaccaagactttctgggcagatttaaagtggctggggttcagaagttcagcaagttggacacacccctcctcgctggagaggagagggcaaaggcgaggcgggggagcagcgtgtgagattccccccttcacacacacaacaacaaagcgtggacacacagaagtgaaatctgatcgcgtgccaggaaaagctgtgaggctggaaaccccggagtaaggctcgaccttggccagacctgcaggctgcggaaccgggggcgcgcgggcgcagcgcagcacagcccggccatggagcacgcggtggccccctgcgtcctctacccagggactgagcccggggctgccggggagagcgagagcgagggcgccgcgtccccggcgcagacaccctgcagtctcggcgcgtccctgtgcttcagctccggggaagagtccccgccgcagtccctcgcctcagcggcggaaggcgcggccacctccccgccctccagcggtggcccgcgggtggtggagcggcagtgggaggccggcagcgcgggcgccgcgtccccggaggagctcgcgtcccctgaggagcgcgcgtgcccggaagagcccgcggcgccgtcccccgaaccgcgcgtttggcttgaggaccccgcgtcccccgaggagcccggggagcccgcgcccgtacccccggggttcggggcggtgtacggggagccggacctggtgctggaggtgtcggggcgccggctgcgcgcgcacaaggcggtgctggcggcgcgcagcgactacttccgcgcgcgcgcgtcgcgggacgtgctgcgggtgcagggagtgagcctgacggcgctgcggctgctcctcgccgacgcctacagcgggcgcatggcgggcgtgcggcccgacaacgtggccgaggtggtggccggcgcgcgccgcctgcagctgcccggcgccgcgcagcgcgccaccgacgccgtggggccgcagctgagcctggccaactgctacgaggtcctgagcgcggccaagcggcagcggctgaacgagctgcgcgacgccgcctactgcttcatgagcgaccactatctggaggtgctgcgcgagcccgccgtgttcggccgcctgtcgggcgcagagcgggacctgctgctgcgccgccgcctgcgcgccggccgcgcccacctcttggccgcggcgctcgggccggcgggggagcgcgcgggcagccggcctcagagcccctcgggggacgcggacgcgcgcggggacgcggccgtctactgcttccacgcggcggccggagagtggcgcgagctgacgcggctgcccgagggcgcgccggcgcggggctgcggcctgtgcgtcctctacaactacctcttcgtggcgggcggcgtggcgcccgcgggccccgacggccgcgcgcgcccgtccgaccaggtcttctgctacaacccggccacggacagctggagcgccgtgaggcccctgcgccaggcgcgctcgcagctgcggctgctggccctggacggtcacctctacgccgtgggcggcgagtgcctgctcagcgtggagcgctacgacccgcgcgccgaccgctgggcccccgtggcgccgctgccccggggcgccttcgccgtggcgcatgaggccaccacctgccacggcgagatctacgtgtccgggggctccctcttctatcgcctgctcaagtatgacccgcggcgcgacgagtggcaggagtgcccgtgcagcagcagccgcgagcgctcggccgacatggtggctctcgacggcttcatctaccgcttcgatctgagcggcagccgcggcgaggcgcaggcggcggggccgagcggggtcagcgtgtcccgataccactgcctggccaagcagtggagcccgtgcgtcgcgcccctgcgcctccccggcggccccacgggcctgcagcccttccgctgcgccgccctggacggcgccatctactgcgtgagccgcgcgggcacctggcgcttccagcctgcccgggaaggcgaggccggcggcgacgcaggccagggcggcggcttcgaggcgctgggcgcccccttggacgtccggggtgtgctcatcccgttcgctctcagcctgcctgagaagccgccccgaggggagcagggcgccccgtaggccggcggggtcggcgggcgtctccctcggcaggggtttgcggggcccaggtccctttgggcccgcggaggaggacgtggtggggagtcggggccgctggccacgctggtggtttggacacttcgaaggagccccgaggacgctctcagggccgctttcgctttgctttccttttgcttgtctttgcttctgggggtggatgccttgagacccaggaggtgtgcggatgggtcccttgacagacaggacacagagaaggctgtgggatccaaagggtcagcctcagggtacagtgggggttcctgaggcagcctgcagccggccccggggtgtcccgaaccccgcagagcaccgaggctgtgcgcaggagcctgggaccctcaagtaggtcgccgcgaactatcgggggaagcacgcagagaggggtcacgccttttatttttggcttgagatttaaaattataactgataagtaaagctctttctgatttagttgaaaatttcgtaccatgtgctcgctttggttggctcaactccaaaaagagtaatttaataagcattaaaggtaaaatctttgattaccagtaaggtttcttgttcaatatgcattggaagtatttccttccccacaccattgctactcaaactcacatgcctagagcagctccgtctcactgttggaccgagggggctttcatattttcagttgaaaggatgttaactgatgtagcgatgatttaccattatttaaattttaagtcttcagtggctaaatgtgaccaaacagcacatcataagtaggaaaaacttaccagggtgcttgtctatctaaaaagcaatttttgatagtccactctgtatgcccagccgctttcataatctggaacgagataaaatattcctaaaaagcggggaaaatcattttgctttgacagttctataaaaaaaagtgtaggcacattttaaacccactgtatatgatgttttcaatgtggatcgtgtagttctgatgagggagattaatttttacaatcagtattctaagtgtggccgagtgacagtgggcatagatttataacaaggaagtgacgtgcttatcaccatagatttgcaagtaaactgcatgtatttaattgtattgaattgagttccaaaataccctaatagaattaacacgaggctcactgcattgacagggtatgaggattaaaaacaaatcagttgggtcgtttctcatttaacattttacttttcaagtgtgtatacagaggacttactattatgactttgaggatgagatccatgctcacaaatagaggcgaacatttgaactccgaatccaacccattttcttactgtaagaggaaaagttactggaacgtaactagttgaaatcctgcctactttaatattatttgtttgttaatccagtaatgggaactgccatctctgtagaaatcagtgggtaattgaaaaataggttatgctttttaaagagtctgtggttatgagaggtctcagttaagtgtgtttagaagtgatcagcttgaaccttatgcatgactcgggggctggaatttatgatctgggttacggtatgttctggggacgtgtctgcttgcccatggttactcatgaactgaggggatagcttggcaacttggttaatcatcttgggaaagaaaaacagacttcatatcgcctgacttgattggccttttataggagtatactggagaaatggttgtagaaacagtatttacagcaaaaggaaacaaataatgttcattttaagcaatgtaccattcacactgtcctgccttttcctctagaattttattaatggtagaaatttttatatgaaatgggaccaggaccaggctaatattttcagtccttaaatatcaaactcatatgctgttatcactgtgattttacttgtgaaatcattcctgtaatgtttagtgtttgaaaatgaaatattgaaattaggtttccagagtaacactgtccccggaaaaggatatgagaagtggtggatgttggatgggggtggttgcacagtcctgtgcggttcccatggctttccagcgtttcatttagtgaaggaatgctcacactagatgtagcacagcttcctgtggggcccggcagcaaagccccaggtgctccctgtcacctcacaacaaaatgcactaagaaacgtaaagaataagaggaattaatacccaccattaaaggatgtccggccaacctattgtggaaatttatagaatagtatacaccacagttctgaatagtgatatcacataaaaatacatactagaggacctgccaagccatgagcagtgtttttgctttttgggggccagtccctggggtgtggagccgctagggtttgcacccatgaaacagaaaagccacaccctccaaggtgtggctttcattttgggactgctgcagggagggcagaggcattgctgagactgcctggcaacggctgatgccccaggtaggaccttttccatttcaaagtggtgttctaagtctgcgtccaacactgtgtaggaaaaaggttggtgcaaaaatattcctggtcatccacccattaaaatagttagatgaggctattgccttgatgacagctgtccacactcctcatgaaattaacccgtatgccggggcatttccaaatgtctgactcgtgaaattaacccatacgcaggggcctttccaaatgtctgaaaaggcagtggtgtcttttggggaaaatgttatgcatggaagcctgaccttttgcttagttgacagcaatcccttctgtattgccaatcaaggttcatttgagatgcagaggaatgagcttgagccttcctccttttccttccggttttattcttcctcttgggaacatccctccactccgcactgcttcctgcagctttgtagagctggatttggaacttcgggatttggtttctgagtctgtggaggcaccgacttctccttggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtc

SEQ ID NO: 387026 - DNA, 1255 bp, Homo sapiens
  misc_feature (19)..(19): n is a, c, g, or t
  misc_feature (35)..(35): n is a, c, g, or t
  misc_feature (45)..(45): n is a, c, g, or t
  misc_feature (57)..(57): n is a, c, g, or t
gagagagagagagagaganagagagagagagaganagagagaganagagagagaganagagagagacagtctcttaggtaacttcctgtaaacgatttggaaataggatgttttcaacgttcttttgtcttttgctgaagtcaggatagattcaagacataatctcttgtaagatctaaatagagcaaatgtaaacaaaagtgcatttttgtattcttgttaattttagatgctttcctagcttacaaaaagttctatttttgggttaaaaatcaatcaactttctgatatttccccttctgcaatgttattgttcataagaaaacacgagctgaaaatggaaatctgcagttgtttcagttgtcttgaatttctttcagtggccacatcatttccacgttttccacatccgggaggaagcctggactgtgcagccttcgggcacccggcacagacactgtgctggcaggagcttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatgaaataaatcacgcagaaagtgccagtcaaaaaaaaaaaaaaaaaaaaaaaaaaaaaaaaaaaaaaggggggggcggaaaaatttcccccgggggggccatttaacctcttaccccagttttttggtacaaagagtgtgccgccctataagaggaagagcgcgtattataaaaaacaggaggcccggggccgcgcgtcggtttaaaccacagcgtgcggtcgagtcgggcaaaaaacgcgcccccagctgggggatatcctggtgggaaagacgaaacctctatctctgtgggggggggcggcactttagctcggcgcacaactctcccctcacagaaaatattagacggcttccagaggggtaatattacaacacattctctccaggttgtcttatcagggggggttcaacaccccagcacgtgcatataatgctcggctgtctggaacaagttgcgtggcttaccgagcgtctactaattttcgcgaacaatttttttcacgcggacga

SEQ ID NO: 387027 - DNA, 871 bp, Homo sapiens
agcccacccgcctggctgcgcgtcccgggcccggcggctgaagaggagccgcggcgaggaacaagagtgtggtgagaggacgcggaaacacctgatatcccagcaaaggaagctgcagaggaagggtcctgccccgtgagcgaggacagcctccaggagcacagcggcttctcctaacatccccctggcagtgaattacggatgaccccgtatatgaggaggtgtggatgccgacacacggggagagctcctgagaccagcacacaggaccagtgtcctccccgtgaccttgcagttgtgtagccacaagtgggagccacagagaaggagagcccataaggggactcttttcaagacacggtgttaaatcaaggctctgaagttggggccacagccggtctcagctttctgtgttctgggggcgcggtgatatgacagcatgtgaagtgagtgggtgagcacggactcctgagagcgagggcgcacccaatacctagttatccggtactgcagagagacacctggtcagccagcgttgcaaagagggatagctagtcactcaggctgcagagagagacacctggtcacccaggctgcagaaacaaccgcagtcaactgcagctccagtcattgctggatgttggctgacgcggtcctggcgccagctggagatccattcaccaagactttctgggcagatttaaagtggctggggttcagaagttcagcaagttggacacacccctcctcgctggagaggagagggcaaaggcgaggcgggggagcagcgtgtgagattccccccttcacacacacatgtgacgtaataaggtgttacagacctggtcctggccacacatcacgtaaggtc

SEQ ID NO: 387028 - DNA, 406 bp, Homo sapiens
aggagggcttgttccagacaacatggtgcctctttatcaagcacagccatgaatcctggaattcatgtcagagggagccactgcagaacttggaaaagtggcaagaggaaggcgaactgtctggaaaccaaacccgagtgtcggaggaagagcagagtggaagggtgccttctgcccccaacccaacagaagcaagggatctggcctttcccatcccccaggttggcaatggaagccagccttggtggactcattcctgtcctagacccaagcggagtccctcctatagtaacaggtgaacccagacccgccaccaggtggatcagttgggagctttgccaaaagtaagtggcctgcggagactccttccctatcaggcctgagaccccccctccccaacctagag

SEQ ID NO: 387029 - DNA, 430 bp, Homo sapiens
gcttttctactaggctctgcatctagatgatggtccagactcctcagcctgtgaaacaaagcccttcataaaagagcagagctacagctagtcagctcccttcctgcagtccaccccctcctccaccatactgagaattggcaattcctgtagcactctttgtatgagtccattttcacactgctataaagatataaccaagactgggtagtttataaaggaaagaggtttaattgactcacagttctgcatggctgaggaggcctcaggaaacttacaatcatggcagaaggggaagcaaacacatccttcttcataaggcggcaggaaagagaagagcgaggagcagagtgggaacagccccttataaaactgtcagatctcctgagaactccctcactgtcacgagaacagcatggggaaaccactc

SEQ ID NO: 387030 - DNA, 398 bp, Homo sapiens
tgaaacttttatctattgagtaagtcagaaatctataccctttccctactctcagatatcctttttttaactgtgatttggatctttctgtcattctttagtcagtagtttccaataatatctgacaactgggggtgggggtgggttaggatagagataatgaaattttgttcctttttatttcagtcatcaaagataagccctgtggcattagcttggtttattatgcaactgtggaagatctagatggcatcaattgtattcatgcaatataatgatcaaaagtggaaagatataggttatagtttgtttccatctgcattctaataaattttctcttgttcttcaacgatctggagatgtgaaagggtacacatagaaaacagaaacccagaagt

SEQ ID NO: 387031 - DNA, 685 bp, Homo sapiens
gatttgggaccgcgcttggtgttggtaccgggaatcgcggccgcgtcgacggattacaggcatgagccacggcgcccagcctaaataagatcttaagattagattggcaattttcagagtggttcatggatacttggggatccccaggacactttctagggagcacatgaggtcaaaattgttttcataataacactaaaacattacctgtcttgactgtttatatttatactgatggtgcaaaagcaatcattagtaaaacttgatggtaccttagcatgaatcaaaacagaagcaccctactttactagaaagttgttttctttattactgtgtacttgcaattttaaaaaacaccacttttgcttaagaatatcactgataaagcaatattttgttaaatctcaaccaataactacacgtattttaaatatctccatgataaaatgataaaagtgtaaagcactacttgtacatgtgaaattgtaatagtagttttgaggaaaaacaagcacttgtgtgatttgtaagctgaactagctgctttttttcatagaataccaaaactactagcgagaacaactaataaaatctattattcacacttgagtatttggcacacattttctcaaaaatgaacaagcttgtgtcactcaaagaaaaaactgacgtacatgaaacagga

SEQ ID NO: 387032 - DNA, 425 bp, Homo sapiens
agggcaaggcggtgtgggcccagccctgtgggatttagctcagcctcactttccctgccgccttgcagaggtctggctgtccttcgagtccccgttgatctctggaattcaggcattagctcccagagccctttaacattcattattctactctatgagctaggcatgatgggggccgtcatgccccttgaacagatgggaaaaccgaggcttggatcacagagctggtgggacacagagccagtgactgacatagaagagcagtggggtagaattacagttccatctggtgccttttctctgagcaaagctgtatccatcaccaccaacagaaagtcccagggaagcgaaaccccagggcagtgtggtgtgattcatgcccacccatctttgtggccttgaaggcaagaaacagaaatcagaca

SEQ ID NO: 387033 - DNA, 741 bp, Homo sapiens
aggaggctttccgggaagagaggatgaggtgtgcttagaagcagcttattggaaagtgacggtttaaattcctggtaacttactttcctcacctgtaaggtggagattgtattagctaagacacttttggttgcaagtggcagaaacccaactcaatctgacttcaggaatttactagctcacagaacttagcagccaaatgtaggtctggcttgggcctggctgagtcctgacatcaggatatgatctcgtcctctccaactcttgactctactttccttgatgttggcttcattttccggaagcccatcccttgtggtggcaaaaaggctgccaaaacccctaggcagatatcccaccctctcagaaatcccaacagaaaaagaaggtcccaggagtatgtctgattggaccaacttgggccacgtgcctatccccaaaccaaggactatagccagggggatggaattctactttgagtggccaagtccagccacctcgctggatctgagggatgggaccagttcttctgaaggtatatggactgagaatgttttcccaaggaaaatggtgcactgttttcaaaataagggggacttgatgctgaataggcaaaggcaaatatgtccactacagggctgggaactgcacctatctcatgcaggcaatgtctagcacatagcaaatatccaagacctgccagtcattatcatcatcattttgccagaggtgggggtttgg

SEQ ID NO: 387034 - DNA, 433 bp, Homo sapiens
tactaaagtatacagtgtgaagctaggaaggtcagtatatgaagggtcttggacaccggactaaggaacctggggactagctgcagggatggggcagggctgataatgggatcagattcgtaaaccagaagatgactcgctcatggggcctctgggaaggacggagttagtgaaagacactccaggcaggaagatggtaaaacattcccaggatatcccatccttcctcagtggatgctctatgaccaagtgttaaagccattgataaaaatggggccaaaccaagcacaaagaattcctctgccaatctctgaatgacaagatgctttgtagggaaagaaaacatgtacagtttggaagccctacatcagaagtggcaaaatgggtcaaaactggcccttgggcttgttttatttggcctgagcaaaaaaaa

SEQ ID NO: 387035 - DNA, 262 bp, Homo sapiens
gttaagttacatatatagataaatgatagacagacatcaacacacacatgactgtttacaaattacggaggttacaaatctaaaacacgtgatttttatctcaaaataataaagattaaaatgttagcaatgttcatccattggtcaaaactttgcattcttgtcttggattcttgcttatattcatcaattttaatctggatctaaacacttaaataaatgaaaataacatattaaataaatttgtttatgcactgcactt

SEQ ID NO: 387036 - DNA, 311 bp, Homo sapiens
tttaatacttcatacagtggaaaagttacagctgtaataaaatcaacagatacatctctggttaatgttctcaaatgagaaaattgactgcaagaacatttgtccaaatacatgtttttatatattttatgctactttccagaatattaacagttttacatagcgctgttttggaagtcactcattgttttcatctttctgattaagaaatagggccaaagttgtacattgcactagtagtagacttttaaagatgtctttgtctctttttcagtactaagcttcaagttcatagattatccttgatcttt

SEQ ID NO: 387037 - DNA, 501 bp, Homo sapiens
agaggaagcagtggggagagccctgtgggtactctcattcccagggaagccatttctgactttttctcacaggggtccttggggaggactgccagtggaattggggaaagaccacagggagaaggaatcttccagctgaactttgtaacaactttgatggaatgtgaagtttcctggacggaatctggtgaagatggtgaacagggagtgcagatatgatcacagaagatgcggcaggctgggaggtacaaaacctgaaagccctgcttgctttctcagtgaggggggttgtagcctggggcaggttctcagccctgctcaccggctgcctggaaataaacctggagctattgaggggacacggcaagagtgagaccagcctttcaggctgcatgggaactgggtgaggcctgtcactgttccctggcgacctgtgtgacacagcagaggcagccataatccacctgagaacataagtccattggcctgagaaccacaccc

SEQ ID NO: 387038 - DNA, 1421 bp, Homo sapiens
agactggatcttgctatgttgcccaggatggtcttgaactcctggcctcaaataatcttccctccttagccgccgtaagtgccgagattacaggagagagcctccgcgcctggcctacagtatttttattataatccatcatactagcgtatttttaacgttccccaccatggcgggtatttttattacccaccatgctatgctatagtatttcaaaaattaatcctattgtagcatgtaaaaatattccattctataccatactatattcatcattacctctgatactacagtatttttaacatgactcattgtgctattgtattttttcattacccacaataccacaatattactgtatttgttagcactgcctgccattccttattattattatttttgcaatggagtctcgctctgtcacccaggcaggctggagtgcagcagtacaatgtcggctcactgcacctcccgggctcaagcgattcttctgcctcagcctccgaagtagctgggattacaggcacgcgccaccacgcccggctaattcttttgtatttttagtagagacagggtttcgctatgtagaccaggctggtctcgcactcctggcctccagtgattcacccaccttggcctcccagagtgctggaatgacacgtatgagccaccacactgacctttttattatttttatccaccatctcgctgcaatttcagtattgcccatcgacctatattgcctcctggtaatgacccctgaggaatgagccatgccatttccataggtggaggcgacgggtcatggtggtgagaacttcactgacctggaagaggtggagaagatgctgggaagctgctgagggctgcccacctgtgttaggagaaggcagatggggacccatggggacagtaatactattttggatccacacaacgggagtggaaaatgccttgaggcacagcagcgtctgaggcgggtgagaaatccggcctgcagagtcgcggctggccttcagatctgcgggctgcctgtgagatgccgtgttacctaaatccatttgggcactgagttccaggagtgggggcaagaattccgatgacggggctttatccggtgcgcatccagctcagagtggttcctgagaccagccaccatgggcagcccaggatgtgctcatccttgaggctttccgaggcatcaaggagatggttggataaagaatttagcacagagcttgactgatggcaggcgcccacaacatgagacacattaataatgtgtgtggaggccaggtgtagtggttcatgcctgtcaccccagcactttgggaggcagaggtgggaagatttcttgaggccaggaattcaagaccagcctgggcaacacagcgagacctcatctctaccaaaaaaaaaaa

SEQ ID NO: 387039 - DNA, 503 bp, Homo sapiens
tgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcggagctctagaaaccaacaagtgtacccaaaccacagccacgtacctcttgcttgctgaaaggatcctgagagaaaagcaagacaaagaaatacagatcagctccgcaagccctagaaatagcaaggcccagctcagctggcctgccatgagaaatacctcaagagtactccagagaattccacaaggcccagaaatattccttccagaagaaaactatacgtaaatctgctcaggatattcaacagctagccagtgcatatgacatatactgggtacttaagaaacgtttgttaaatgaatcatgattataaagaaaaaataaattaaaacttatgtttagttaaa

SEQ ID NO: 387040 - DNA, 1823 bp, Homo sapiens
gcggccgcgggtctcactgcaaagagggtgtggcctaaactctggccgccgccgaaactctggggccgcgcttggccgcgagtacaaagcgggctggtggccgctttgcggcactgccccggccgcgcgcctcccggggggcccacacccctgcgttcctgaaacccttcttttgaaaaatgccctttcgaacgcaaccgtccgccccagagccacgcgggcacggctcgagggaagtttgtttcctttttcaaattgctccggtcaccttaacggtttgagtcttccggagtcacgcccgcagcctcgctgcccccatctggcttgggcagggccgaagctcgtctcccgctttaagagcgcgccagccatttctctgcctgctcttccaggccggctgggcggggggcctcccaacggcttcctctccagttttcaaaggctgcacatttcacttaactatttgaagtatttataggcaaatacaatacgcagggaagcttcccgccccgagacagctcctccacgcaacctaccacagactctgtaattagagtggcctgaagaagccgggagaggctccatgaccccggcaggctctggccaaaccttgctgcgtttcatggagcccctccctgtccgcgcctgggacgcactggccccaacaggttcctcgactcgaattcgctgtttgggttgctctgtggtttcctcgctgactgaaagtggatgagaataagaaggaaactgagagatgatcaggcaggccagccttcgcgatttatgaatgaggagcctcccaccctgtagaactgcttggattagaagtgggcaagttatttaagcttacatgcatgcttataaagcttctgttttcacatgtagtaaggtggaggcttgacgacatttacctaatgagctgttgtttggattaaatgagatggttggtgcatggcagtcatttagcacaagtacctggcaatgtaagagaccaataaaagctgggctttattttccctgttgttaaattactgctgctttcccccaaagtcatctctgtttataaactatttgtctttcttctttgtttccaggacactttgtgcccaccctatagcctgatcttcagtgctgatagcattgatttagaataactcagatgctattaactctgtccccctggaattcatgttaaacccgtaatccccagtgtgatggtattaggaggtggggaactttaggaggtaataaggtcaagacagtggagccctcatgataggattagcactcttattagaagagacaggagagagatgctttcttactgccttgtgaggacacagaaggcagtcttctgtggaccaggaagagggcccttaccaagaatctgataccgtgttggcatcctagtctcagacttccagcctctagtactgtaagaaataaatgtttgttgtttaagccatcctgtttatggtatttttgttatagtggcccaaagtgacaaagatctcagaccagaggaaacatcaaagtcttaacctctgaagcattaagaaatgagaaggcaccttcttagccattctaggtagcaactttctactctagttaggctgaaatgcacggccctgtctatgtctgtttcagttatcctccctctctctgaaatcaagtcacacatcattcatgctacttacttaacactttgccctttgccatctgatgccacctcccgtactattgtctcccattatttaacctgttatttattgtttcatgcattcattttcatcttagagaataaacatcttggaattaaaaaa

SEQ ID NO: 387041 - DNA, 480 bp, Homo sapiens
ctaaaataattgtgcaaactggtgtccttccaatctttttgatacctatataaaagtttatttccatataaatattccacttcagctttctaaaaaacttaatataatatagagatatttctatatcaatacatataaatttaatttagcaatggcaaaaagttagaattcatctaaagatttctcagtaaaggcaagcccaaatacactatgaaatgtccattataggtagctattgagaaaaagataaattgtatagtgtgtgtactaacatgaagagattacaaagacattgttgagtagaaaaggcaggttgcagaactggacacaggacaaggagtaccttcaaaacattatatggccaggcacggtggcttatgcctgtaatcccagcactttgggaggccgaggtgggcagatcacttgaggtcaggagttcaaaaccagcctggccaacatggtgaaaacctctctactaaa

SEQ ID NO: 387042 - DNA, 331 bp, Homo sapiens
gctaagaaacctgtattttactccactagaatggaaactttgccataccacagatattttaatctgttcagagattatgcaaaatgaatacatttatgagcactaaaataatcttatgtagctgagtaagctccaaatagagtatattctcaatttggaggaaccaagataataaaataatgctctaaaacagcagtgaaaagcaatacaaaatggtggctatatgcagaaatagtctattctaagaaggtccataaatgtttactgatgagcaccacatttctctattctccatcatgacatcatgatatatttgagaagacaacaccgg

SEQ ID NO: 387043 - DNA, 440 bp, Homo sapiens
gaagactctttatattttagaactgactgtttatattctgaaactgactccaaagtcaagcgaatacccccttttcacctacagtatatgtaaggtggtaggtaaatagtataagaatttttatttctgtttcttttcatttatctttattttctaatctcactcttctcaaactgtagtgaagaagccatttttatggccaatccatcatggactgataatttccagaaatgtaataaaaatcactagaaaaattaaaaagcaaactacaagccataattttttgttatcagattcaacagatatacaataactgtcagtttgctgtgaaagtttctagatgcttgctatacttctgttgtcactgacgggtaactaccagttcatgggtgagccatggtcgcagaccatgcttggggtagtgttggtttcgaatctgc

SEQ ID NO: 387044 - DNA, 303 bp, Homo sapiens
ggagtagtgacattaagctgagatcttctactaattctagacataagtttccccagtgggtttgctcttttgctgatttaaacaacaatgtattggcactggggttcagagtgggataagctaggaaactaaagggatttcaggggaaagaatcaccccaaatcatttctcccttccatttctcttaacagaacgctctcttctgtgtcataccctaaagttaaccaaaaaataatctggatactccacctctgcataaaacacagatcacaatcattatcatacattcttcttcgcatctca

SEQ ID NO: 387045 - DNA, 821 bp, Homo sapiens
agcggggcatcagacctgaggacagaagggttcgggctgcaaggaatcctattgtgtgagagccatgacacagtgagtgggagttttgatcttgacctcctggagcattttcatggaaaaggcagttccaggattctttgtggcctcttccacaggagaaagtaaaggagctagaggcctctaaaaatttagttattgaagaactgaagttattcacagcaacctggcagaagagaatgtgaaatacgtgggtctcaggtaataggtaatatccctaattccacggtgatgctgagaagcagagggcgccctcagaagtagtttctcttaaggaatttgcagctggcctacaagaacaggaccacagaatcaggtcctgtaaaagggtatgtaaaagttgtattttttgcacatctgtcttgtattctgagtcacactcctctcattgattatccttcacaatagccgttgttttaacagcgttatggagataaagttgagatggcatataattcacccatttaaagtataagattcaatggcttttactatattcacagagttgtacaagtgttaccacaatcaattaaaaaatgttctggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcaccaaaa

SEQ ID NO: 387046 - DNA, 484 bp, Homo sapiens
tcgaaattcaagttttggtcaaataaaactatagtcacttagagatttttttctaaattattattattatcttcagcaataacatggattcacagaggaatggctaagttaaatggttaaatagaggctgtgaatggaatctcataccccaatagactttgggggaagagtcaataggtttatatacataaaagtcccaagcagtccgcctgcccctgaagggtaaggacgcaccgagcactccctttctcctttcagtggcaacactcagcaagattgattgccaaggagctcactttgaggaggatctcaccatcgcccttcagttttcaccaatgcacatcagcatgtccctccccagcacattccccttaaaatgtgtattttcatagcaaaccaccatggcgcatgtttacctatgtcacagacctgcacatcctgcacatgtaccctagaacttaaaataaaagttgataaaatgtca

SEQ ID NO: 387047 - DNA, 508 bp, Homo sapiens
cgctgagtaaatcctatggggcgacatatttgattagattcggggtcagtgggtgaggggacatactccagtcattacaatctgaggacagcgctgagcactaacagatgtgacaacttataacacaggtacttcctccttcactgcactttatccaaaaatagacatcttcagaggttctttaccttttagccttaaaggatttgagaagctttagaaaacaaattatgatatcaggtctagatttattttgctattaaagtctcacattctgtacaagtattttattattgtttgtctaggtctctgaaattagaagagacagaagaaaacatattatataaatttaaagtatgaattagccaggcgtgttggcacgcacctatagtcccagctactcggggagctgaggtaggaggattgcttgagcccaggaggtcaaggctacagcaagcccagattgttccattgcactccaggctgggtgacagagcaagaccctgtctaa

SEQ ID NO: 387048 - DNA, 411 bp, Homo sapiens
catgttcatggataggaaaacaatattgtcaagatgtccattcttcccacttttatgtatagattcatgtagtctcaatcagaatcccagcaagttatttcatggatatcaacaaactgattctaaagtttatatgcagagacaaaatacccaaaatagtcatcatactattgaaggacaaagtctgaggactgatactacctgacttaaagacttactgtaaactttagtgaccaagacaatgtggcattggtgacaggacaaatagatggatggaacagaatagagaacccagaaatactcacataaatacagtcagttcaacttttaccaaggagcagaggcaatacattggagcaaaaaatagcccttgaggaaatggtgctggaacaaatggacatccactttcag

SEQ ID NO: 387049 - DNA, 570 bp, Homo sapiens
ctcagccctggtctgctggctgaggagcctgtgtcctgctggcagggtggccctttccctgctgtcccctcctgtgccttctgagccaccgtttccctcacacagccttgttcatcaatacactccggccacgcaggccctagcattgttttttagaaacctctcatcttttgcttgttggtttccttactgttatcctttgatcttaagagatttttattccttgattcctccatgttcaaggtgtcttaggagaagaggaagacaaatagtatgccctgtctctatctacaatttgtcccttttttaagatttctactttgggttaattttcctggtattagaacaagtcttgcttttggccaagcccaggtatggggaataatttggtgttcctttcaacagatgtttcaatatttgttcatttgaggagaggtgtctgggaggggtgctggacagcagcagctggtggtggcttgacaggttcttggccatcccaggtgactgtgcctagtccctaactcacaggccccagcccacaaaacaaaagccagttcttagccagcacca

SEQ ID NO: 387050 - DNA, 155 bp, Homo sapiens
cttggtattcttacatccctatactctacaaatgacaaatgaattcagcgatccttttaaactattaagtcagatcataaaactcctctgttgaaaactctccaacgccttcccatctcactcaaggtaaagtccaaagccctttaaaaaggtaa

SEQ ID NO: 387051 - DNA, 824 bp, Homo sapiens
acaattataactaataacaaaatagaacaattataacaatatactgtaagaaaggttatgcaaatgaggtctctctctctcaaaatatcctattataccatactcacccttcttcttgtgatgtgtccatggctggatgtcaggagcagacaatgtcaataactcacaggtaggtagcacatacagtgtggatacactggacaaaggagtgattcatatccccacaggacagagtcggacgatgtgaaatttcttcatgctgctcaaaatggtatgtaatttaaaacttatggattatttctgaaatgtttaatttaatattttcagactatggctgatcatgggtaactgaaaccatggaaagaaaactgctgataaagaaaatactgtattgcaatttgtgggcagcaaaagtccatgtctatatcccccataatagagtgctgagcatacagtaaatgttccacttactaataccacaaatacgtacaggcaacatggcatcatggttactacttagtagcctgtgtttgaatcccaactcagccacttactatttattagtcccgtcaacttgaccaagttacttaacctctctgttcttcaatttccccatctgtacaatggaaataatgtgttaatacatataggcaacccttggcatcctggggattggtcccaggacacccctcataccaaaatctgtgaatgtgcaagtcccttatataaaatggcatagtatttgcatataacctactcatatcctctcatattctttaaagcatctctagattacttacaatacttgatccaatgcttgcaca

SEQ ID NO: 387052 - DNA, 496 bp, Homo sapiens
caatgaagatggcacattttgttcagggaatggtgaattaagtgtggcagaaatgctttgtagagacagtaatttgcttgtatggaattttgcccaagagacctcattacagtttctaattttttgatgttatcatgcatcactgcccttgtcagatagtatcatgatcacaataacatcaagcataatatttcattgattctcacaaaaacaggtgggtgccacagttatccccattatatgcacaaaatgatgaagacttggggttaatgagcgatttgcccaagctcacctgaatattaagactgagtcaaatgttagtctggtctgacttcaatgcttgccttgttcatgagcaccatgcattgcctctcctatgcagttaagcaggtagacaggtgagagaagagcccgtgtgatatcgggggaaattcaccccgatatttcatgtaggttcttttctgttttccctgagtgttggccggtctgagaaata

SEQ ID NO: 387053 - DNA, 240 bp, Homo sapiens
tactactactactaaattcgcggccgcgtcgacgctttatatctcttagctattacagccaccaatgattccagtgccatgcactgttctaattcatgtaatatcaatgatggtgataatgacagttaatacttaaactattgtgcttatgttccaagcactgttttaataactttaaatgaattatgtcattcagtctttaaaatcaccctaaaacatgtcgacgcggccgcgaattta

SEQ ID NO: 387054 - DNA, 449 bp, Homo sapiens
cccctgaatccttccgtttccctgccaaatcatttgatgttgattcaggcccctctcagtgctgcagagccctcctaagagaacttctcccacttctcttagccccagacccagcttcccttggttggaggagaaggaagcgcaaacgcggatactgcctgcatggtcctgcgaggaagccccaccctggccctggggccttctgtttgcctgtcactcgctctcgatgctaccttctctcaccagtgctttgggtccttcccagcacagggcccagcatagcccttctcttccacctagcagattccagcacattctttacttttcttttttttttcttgagacggagtctcagttgttgcccaggctagagtgccgtggcatgatgtcagctcactgcaacctcctcctcctgggttcaagagattgttttgcctcagcctcccgag

SEQ ID NO: 387055 - DNA, 296 bp, Homo sapiens
tgcagtggcatgatcttgactcactgcaacctctgcctcccgggttcaagtgatgcttctgcctcagcctcctgagtagctgggattacaggtgcacgccaccacacttggctaatttttgtatcattggtagagacagggtccttgccctgttgcccagcctggagtaagcaatccttctgccttagcctcctgagtagctaggatactactactaaagtgcatgtcctttctttgttatatcagtaaagaagattgatggattcttattttactcagtggattgcggttcttta

SEQ ID NO: 387056 - DNA, 729 bp, Homo sapiens
atccagttgctgcccagtgtcctagttaaacatgacattttctcaatcattctgcctgaaatttctctgatatctttttataaagaccttgctggctcagtcttcatgcagcctcagtactttgcattataatccattagcttatgatgattacaactaacgcaaaacttagagatgtaaagcaacagccattttctgcatctcacaatactggaggctgcatggatgtttcttctgatctggtctcccatgcatctatggtaagctgtgagacaagctgatggctgcacctgagatggtctctctcatacatctggtagctgtctggctgtcagctgggatgccttggttctcctcagtctggcttcctggctccaataggctagcttgagctctttcatagggcaaacttagggttccaagaacagcaagaggatagcctcaatgcaacagtgctctctaagcctctgcttcaggcattttgctgaagccctgctgaccaaagcaagtcacatggccaactcagttttatgggataccttgatggaggtgatttgcactgccacatagcacaacagagtgtgctgcagacatgaaaagatttttatggccaattttgcaatgtctcacaattaaatttgctatttttgttttatttgctagttcacacattctggaaataatgaaggtatggcactccttctatgtgaacaagtcttctgcagaaat

SEQ ID NO: 387057 - DNA, 288 bp, Homo sapiens
caaaaacagacccacagagacggagttggcagacagctttgcagttctttgaatctggccaaagtgaacccagctgttgatcataactgcacaaaattatttcagagggcctactaagtgcaaaagcactgtgctaaacactaaagaagacaaaagtaggaatacaattgactccataccctctaaggatgtattaaaaagttgtgttgggcctatgagtgaactatctgctactttatcattctttaaaatgatgaacttgctgggaatttaaaatagacctttctg

SEQ ID NO: 387058 - DNA, 1018 bp, Homo sapiens
tgcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccccgcctctcagcccgaggccacagcggcccagcaccctgcaccttttaaagtggctccaaaaaggagaaagccaaatagatcagggtggtaggcgcgagtgcagggagctgcgaagttggaagattactgcttttcaaactgccaaagagcaaaatactaagcgagaaactccgtccaaagcaactggaactcgaggttctttactaatgagagttccagttaccatcttcagagaaaggagctcaaaagagggagtttattttttgcggaatgtcttccttgttaaggtttgctattctaaggccgagaatgccagatggggagaacgccatgagcttttgagcttgtgtattttgcgagaggctcgagtgtgaacagtagactacaggccttgagactgagaaggaagctataaaatgtgggccaagggaatgtctgcaggaccgggtttcagagcaccctatcgtggcggataaagagccactaacagcttttttctttatttagtagccaaattcttggttggcgctttgagaaaggagtaagcattaagcgaatttaaccaagtaaaatgtatcgtcctgccctttgtagtcccatagttcactatcctagagatacctatttttcactattttattaaagtgtattgaaaacctaaaaaaaaa

SEQ ID NO: 387059 - DNA, 1084 bp, Homo sapiens
tgcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccccgcctctcagcccgaggccacagcggcccagcaccctgcaccttttaaagtggctccaaaaaggagaaagccaaatagatcagggtggtaggcgcgagtgcagggagctgcgaagttggaagattactgcttttcaaactgccaaagagcaaaatactaagcgagaaactccgtccaaagcaactggaactcgaggttctttactaatgagagttccagttaccatcttcagagaaaggagctcaaaagagggagtttattttttgcggaatgtcttccttgttaagaagaaaattaaagattaaaaaagaaaatgaagggtctggcaactatgaacctaatggtgccctaacgtttgctattctaaggccgagaatgccagatggggagaacgccatgagcttttgagcttgtgtattttgcgagaggctcgagtgtgaacagtagactacaggccttgagactgagaaggaagctataaaatgtgggccaagggaatgtctgcaggaccgggtttcagagcaccctatcgtggcggataaagagccactaacagcttttttctttatttagtagccaaattcttggttggcgctttgagaaaggagtaagcattaagcgaatttaaccaagtaaaatgtatcgtcctgccctttgtagtcccatagttcactatcctagagatacctatttttcactattttattaaagtgtattgaaaacctaaaaaaaaa

SEQ ID NO: 387060 - DNA, 362 bp, Homo sapiens
gtctgcacagaatgtaggcacactctgcctagcctgtaccaaaatgtcagactaccagcaggagaacaggtgttctgcataaagcatattgtttgtattaacagttcaggcatagtgagccactgttatcagaaacctaggtttctagaggccacccaagagtcaaccttacaggaaggcctttctaagcataaacatttatgcttgccatgtttaactcttctgcacagcaggggacctacccaaaatagccaaaacaatcttggaaaaaagaacaaatttggaagactcatacttcctgatttcagaacttctacaaaggtataataatcaaaactatgttacactggcacaaggataaa

SEQ ID NO: 387061 - DNA, 318 bp, Homo sapiens
ttcatgctcctcaccggggcccctctcctatcacccaacttgcctcctcccagagatcttcctcagtgctggaagctgtgccttctatcaccattccctatttctctttgccgggctcagccggggccaccttacagtaatttttttttctctgaattcctgtaaaatttgaagtctatgttcgctaatgtaataatggattaaaatgtgcttggggtttttttttttttttttttttttttttttttttttttttttttttttttttttttttttttttttttttttttttttttacccggggcacaaaataataaa

SEQ ID NO: 387062 - DNA, 1991 bp, Homo sapiens
cttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387063 - DNA, 1884 bp, Homo sapiens
cttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387064 - DNA, 1779 bp, Homo sapiens
cttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387065 - DNA, 484 bp, Homo sapiens
tttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaa

SEQ ID NO: 387066 - DNA, 2175 bp, Homo sapiens
gctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387067 - DNA, 1787 bp, Homo sapiens
ccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387068 - DNA, 960 bp, Homo sapiens
gctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggcggagaag

SEQ ID NO: 387069 - DNA, 1762 bp, Homo sapiens
gctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387070 - DNA, 1721 bp, Homo sapiens
tttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387071 - DNA, 1783 bp, Homo sapiens
gctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatccaaaaaaaaaaaatgaaaacaa

SEQ ID NO: 387072 - DNA, 1852 bp, Homo sapiens
tttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387073 - DNA, 1369 bp, Homo sapiens
ctccttgcaggatgcccggcgggtggcttcttgctggagggcacagagacagggcgcaccagcttcagctgaaccttgatgaagcctgtgtaagaaccgtcctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 387074 - DNA, 592 bp, Homo sapiens
ttaatataaggagtatctcatcattatagagtacgtggcaggttacaaagacctttacataatgatgtcatttttatgacaatccagtgacatcaataaggcagggattattgactcccatttttgagataaagaaatggaggttcactgctgctaggtgacttgctccagaagagatgactgaactctccagggagcctatggactcaccgcttaggggtagagaggaggaacctccttggtcacgtccctgggggtgggcagtgaaagctgatccatcaagagagaagcaagagtcacctccaaatgggctgagagggacggacagccacgggccacctggtactgagttctgttgctggactagggactttatgaggacaaacactgttttcagtcatctctttgttctcatgctctagaacatgcttggtatatagtggacacctgaggaatatttgttgaaggaattgagacttttcaaaatatgacaaatatccactgttggaatgagcttccctgaagagttgtgtgagttctagcactgtcagagtttaagaaaaaatgataaatatctgttgactaataaaaa

SEQ ID NO: 387075 - DNA, 1097 bp, Homo sapiens
ctttttcaagattctttttaaagaaaatatatggtagctgttgtttaacatttatctacttacagagcgttcagaggatgttatatgtttattaagtgctcaatactgtattttaacctaatctgaattttaatcataatcctgcacaatgcatggattctggttgctttgaaatggttctgttcaaaggacttatcaatgtctcttgctttgagatgtattgcttggtgtgtagtagcacaaacgtaccaccaataatgtacctaattcaactgaagtgacagtcatatacgcagatatgaccaagttcacatgtgagcaagtaacaactccatgactgttgctgcctggctaatagctactatactatcatttgtaaggcacattctgttttctggggtgtcgaaatgtggataaaaaaagatgaattaggaatgattctaacctaagtatgtgttttaataaaaggatctaggcaaaaaaaaaaaaagtaagtcactcctaaatttaatccctgaataatgcagtgtacatgatgatagaggagaagtgtgtttttgataagaagtgactaaattttgtgacaatcttaattttttaggcttttcatttagtcttccaataaagataatttttttctgagttttatcagcagtagaaaaataagacctacatggataagtttgaaattaaacattttgtctcattttataatttttatttttatgaaatcatggcgcttacatcatatactcaggtgtgtaaaagcctgctatttgtaactataatccataaacttattgatgatttaataactatcaacaagggcatgggaaaaattcaacatttgataataatcttttaccttaggcatttattctctaagcaaagcagaaataaaggatatgtatcagtgtatactgattgaaataaagctttaaaaatccaagtgatactctgaaattgtcaaaagtttaatggcatgaatccaggattaattcccataacctgtgatgatctagtcatcttctgtagctacatagtactcctaatgttaagattaccaaattcagcaataaagccaaaatcaaaactgc

SEQ ID NO: 387076 - DNA, 711 bp, Homo sapiens
ctttttcaagattctttttaaagaaaatatatggtagctgttgtttaacatttatctacttacagagcgttcagaggatgttatatgtttattaagtgctcaatactgtattttaacctaatctgaattttaatcataatcctgcacaatgcatggattctggttgctttgaaatggttctgttcaaaggacttatcaatgtctcttgctttgagatgtattgcttggtgtgtagtagcacaaacgtaccaccaataatgtacctaattcaactgaagtgacagtcatatacgcagatatgaccaagttcacatgtgagcaagtaacaactccatgactgttgctgcctggctaatagctactatactatcatttgtaaggcacattctgttttctggggtgtcgaaatgtggataaaaaaagatgaattaggaatgattctaacctaagtatgtgttttaataaaaggatctaggcaaaaaaaaaaaaagtaagtcactcctaaatttaatccctgaataatgcagtgtacatgatgatagaggagaagtgtgtttttgataagaagtgactaaattttgtgacaatcttaattttttaggcttttcatttagtcttccaataaagataatttttttctgagttttatcagcagtagaaaaataagacctacatggataagtttgaaattaaacattttgtctcatttta

SEQ ID NO: 387077 - DNA, 220 bp, Homo sapiens
ggaggatcactgagcccaggagtttgagaccagcctgggcaacatagcgaggcctcaactctatttaaaaaaagaaaagaaaagaatccatcacaagtacttgtctgtgtgcccggcacatggtaagtacacaaagatggtagcaattagtgttatcatcatctgcatccgtgtcagtagcccactgggaaggcctgggtctcatgttcttttgtcactg

SEQ ID NO: 387078 - DNA, 364 bp, Homo sapiens
gagtccccccacaacccgccctcccactagctgcagaaaagcagctaggcttgagccgttcaattcagtagccattaggattatgtggttcttcagcacccagtgtagccaaggaattgaattttttaagtttaataaacttaaactttaaaactgaacagtaacatatttgtccatgaagacaactttattgttttgtagaactacttactgtattcatttccaattgctactgtgatgaattaccagaaaccttgtcacttaaaacaacaggctcggtacagtggctcaggcctgtaatcccagcacttcgggaggctgtggtgggcggatcacttgagtccaggagttcaagacccaactg

SEQ ID NO: 387079 - DNA, 543 bp, Homo sapiens
cacttgtatatgatgatattcatgccagactgttttttttaaagcaaaagttagaactgtaaagaaaatgctttttatttttcttagaatatagtaacacaaaacattttagttccactgttttaagtctttaaatgaaaattatgtcctcctaacttgatatttgtttcatgtaagctaaatttttgctttctgggatcttttatgatccccttgcccctgaactgtctggtgaacactctgcattcttggtgattatgcccttgggggagaatcaacaaagctggaaatgaccacaaagaccactatagaatctgtctaggacactgtaacacgtgtttgaaccatgactaaactctgtggttattaagagaaatgccttgaaaataagattggaacctctgggtggagggtagctctgaatctactagcaagcaagatgtaaaacacagtaatgcttttagacatgtaaggcccaaataaagagggtcactacatagagaattcttgtttacaagaaatatactgagtacaacattgtaa

SEQ ID NO: 387080 - DNA, 178 bp, Homo sapiens
acagatcggacacttgatcagttgtaggcgattgtcttataccatgtcttaacatatctgcttgccttcaaagtcccgccactccacccccacctcgctgaagtcacgacactgagctgagcatgtgaaagcccctgtcctcagtgactctgggccaggtccctccttacacgtggat

SEQ ID NO: 387081 - DNA, 405 bp, Homo sapiens
ctctcttacaaaaacagctcacaaaattctgaaataaattgtgtatgaaaatattctctacttcaagattgctctaaaggtttagtaattaagacagtgccatttcccaaggataaaatagaacaatggaacacaatagagtccagaaacagatcactgtataatatggacacctgatttatggctgtgatgccaccacaattgagtatgagaacaatcattttatcaataaacagtggtgaatcacgtggatacctttatgggaaaagaaatgaacttgactccatatacaagttaatttgattgttgagcatggtggcacacacctgtagtcccaactacttgggaggctgaggtgggaggattgattgagcctaggagtttgagaccagcctgggcaaaatg

SEQ ID NO: 387082 - DNA, 539 bp, Homo sapiens
aatctaaagcccagagtaaaagagagagttaaagagatttgggagttgttaccacacatagatggtaagtgaaaccatgtgaatggatataatcattataggtaggaaagattgttttctgcttcacaatcgctgtgtctaatatgcatgtgcataaaatcgtaattctttcctaccgttttacaacttatacaataggttgttagcatactgttataaatattaaaaaaaatttatttgaaaatgactgccttatctgttacagagaaacttttttgaaaatttgatgttagacagtattttctatcagtttcctgaaattgtccattctacatgatgaagaaaaatgaaaattaaaaagtaaataaatgggccaggcttgttggctcacacctgtaatcccagcactttgcgaggccaaggcaggtggatcacctcaggtcaggagtttcagaccagccctgccaagatggggaaacacatgtctactaaaaatacaaaaattagttgggtatgatagcgtgcacctgtagtcccac

SEQ ID NO: 387083 - DNA, 219 bp, Homo sapiens
tttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttgggtgtgtaaggcagagagaagaccgcgaggaacggaaagcgcatgcgtcctagtggtgctgcagcgcc

SEQ ID NO: 387084 - DNA, 1072 bp, Homo sapiens
gtttctttagctgaaataatataggctttttttccaggtatcttttcattattgatttctagcaagtttatattttgattagaataaaaacttcatgctactttaatcccttgaaattgactgagacttgctctatgaccccaatatgagattttttttctgtgactcttccatgtgttttttaaagcattatgtattctgtcattgtaggatatagttctttatttatcatttaagtaagtttattcattgtgtggttcaaattttcagtattcttcctaagttttaaactgcttgtgcaaccaattgctaaaagaattgttaaaatatcccacttcagttctggattccttgatttttccctttagttctgtcaattttcctttgtatatttggaagccatgttattagaggcatgtagtttaaagttgttttatatttcttgtggattaaatctcttattatgatatgattgatcttttatatctgtaaagtatttgtgcctaaagtccattttgtctgctattaatatattgatactagccttcttttgcttagtgtttgcatagtatatcttcctcagttctcaaaaaatttaattgattagccagacatggtggcacatgcctatacttccagctacctgagaggctgaggcaggaggatcacttgagcccagaggtcaaggctgcagagagtcatatcccgccactatattgtagcctgggtgatagagtgagaccctgtctcaaaagagcaaagaaagaaagaagaaagggatggagggagggaaggaggaaggaagaaacgaaagaaataaagatataaaaaagaaagaaaaaattaattgaaatataattcatatataaattctctcttttagtgtacagctcagtagttttattcaagagttgtacaatcattatcactaattctagaacattttcatcactcaaaaaactgtacagttagcagtcactccctatttccccctctacaaatcccctgggtaccacaaagctactttttgaatctacagatttgcctattctggacatttcatataaatgag

SEQ ID NO: 387085 - DNA, 1018 bp, Homo sapiens
gtttctttagctgaaataatataggctttttttccaggtatcttttcattattgatttctagcaagtttatattttgattagaataaaaacttcatgctactttaatcccttgaaattgactgagacttgctctatgaccccaatatgagattttttttctgtgactcttccatgtgttttttaaagcattatgtattctgtcattgtaggatatagttctttatttatcatttaagtaagtttattcattgtgtggttcaaattttcagtattcttcctaagttttaaactgcttgtgcaaccaattgctaaaagaattgttttttcctttgtatatttggaagccatgttattagaggcatgtagtttaaagttgttttatatttcttgtggattaaatctcttattatgatatgattgatcttttatatctgtaaagtatttgtgcctaaagtccattttgtctgctattaatatattgatactagccttcttttgcttagtgtttgcatagtatatcttcctcagttctcaaaaaatttaattgattagccagacatggtggcacatgcctatacttccagctacctgagaggctgaggcaggaggatcacttgagcccagaggtcaaggctgcagagagtcatatcccgccactatattgtagcctgggtgatagagtgagaccctgtctcaaaagagcaaagaaagaaagaagaaagggatggagggagggaaggaggaaggaagaaacgaaagaaataaagatataaaaaagaaagaaaaaattaattgaaatataattcatatataaattctctcttttagtgtacagctcagtagttttattcaagagttgtacaatcattatcactaattctagaacattttcatcactcaaaaaactgtacagttagcagtcactccctatttccccctctacaaatcccctgggtaccacaaagctactttttgaatctacagatttgcctattctggacatttcatataaatgag

SEQ ID NO: 387086 - DNA, 747 bp, Homo sapiens
ccgtgacgagacctgttcactcgtggcactcgggatgtagtgggagaaagcagagaggtggggacaagaggtgccatgaggaaccccacaaccatagcagggcctctgcatgccaggataagtaggcactccgtttttaagggtctcgtcacagaacatcagcatgatcctggcagcccatagaccagacgtccttgaggtcttagcgccaccgcctccctgtcttcctcatgtaggctgctttcatgggaaactgatggtacatagggcggatgcagctcttggaacgattttgttttccagggccaggtttcagaatatggctgtatgtttaaaattatgtctagctgccattaattcctgttgtccccgcatgtctgaagaacttagccactcttattccacctgtaccctcacccactcctcccacgccacccctcccatgccaccagctcttttgaagagaatcctcgatgcgtgccacctatccgtatttcagtatgcctccctggaagagaagggcagggtgcaacagcagcaacccccgaggagtgtcccactgaggctgctgcctcttcagccatagggctctgggcacttggggcttcttcgccagcgcagctatggtcgagtgtgtttcagcggcatgtctttgttgcctttctcaggtcgagtgttatctgttcaaaccccaccttttaaatggtcccatgagagatgagatttttttcctattagttggtacct

SEQ ID NO: 387087 - DNA, 768 bp, Homo sapiens
tgagggacaggtgttaaaaaaggaaaccaagtaccgtttgtctccatcaacaccaggcacttcagaaggtgactttcacagagcccagtgtgctgagctcttctacagcggatgcctaatgataaactttaaactggagaaaatgccctggtactttctgcagcctcaggaataggctccagtgtgtggcgagtgttcatttataggcagcgctcggcatggggagtctggacaccatatatccgcccgggagtgtattaacgtggaaaccaagcccacccccaactccgaaaagtgcagcagcttttccagttctttgtgcaaatatgtaggctctgtacgtgtggggttactggtttccaagcacaaggcaaaggcacggggcagtaaggagggtgccttgggagtaatctgctggcttccactacttcccttcctgaggcacggcttgctgctgtggacatccctgggcctaccccaagctggcccagtatctgtggttaaaacaaccgcccccccccccccgcccccacacacgtggctccttatgtgtatgtaggcatttctacttttcaaaattctgctctgtctgtattccctttggtcttcacagtaccctatgtgggatgtgaggatcaaatgtgtttcagtaataagcacgcatttgcctagtccctgtggttcctgagagtgttgctggtatgctgtcagggcatcctccggccgtccatgtgacagggtggctgtctttctgtagtgtgcagaaca

SEQ ID NO: 387088 - DNA, 727 bp, Homo sapiens
ataatcccagcactttagggggccaaggcaggaggatcgctagagcctgggagttcgagaccaacttgagaaacacagcaagaccctgtctctattattattattattatttcgagatggagtctcgcactgtcacccaggctgaagtgtagtggtgccatcttggctcactgcaacctccacctcaggggttcaagcagttctcctgccttagccttctgaggagctgagactacagtcgtgcgccaccaagcctggctaatttttgtattttgctttcgccatgttagccaggctaatctcgaactcctgacctcaggtgatccacccgcctccgcctcccaaagtgctgggattacaggcgtgagccacagtttctggctccctgtctcaatttaaaaaaaaatttatatatatatattaaggttgttgtacagtagtgtctggcacacagaaagtactttttcctctgattctgggctcttccagcaacatttactggggcacctggctctgctggggagttgggcagtggaaaaggagaaccaggctatgcctctggaaagtcagagagaagagtcctctaccatgggctgctgatcttgtgcaagccactccttctggccaatcagtcctcagtttggccacctgtatggtggcagagcactatctgtcccccagggctctcccgagggctagaggtttagagattcagttcctagggttc

SEQ ID NO: 387089 - DNA, 265 bp, Homo sapiens
gagtatttgactcacccttgagattgatggagcccaggctctctgaggatccaggtgaatctagaacttgtactccaagtgtggactctcctgcagttgctcaatgaagtcgctgatgatgggactgagtacctactccaacgtagcagggatgctggtgctgggttcaaaatggccaatgtgtttaattactttgtctgtgtttaagtattttctgtattaaacattttatgttttaattatgttttttatgtatgaagtattt

SEQ ID NO: 387090 - DNA, 659 bp, Homo sapiens
ctgcaacctcagcctcccaggttcaagggattctcctgcctcagcctcctgagtagctgggaccatgggcatgtgccaccatgcccggctaatttttgtatttttagtggagacggggtttcgccgtgtttccaggctggtctctaactgctgacctcaggtgatccgcccgccttggcctcccaaagtgctgggattacaggcatgagccactgcacttggcccaaaacttctatctcaaagcacagagaccttgggggaagcaaagttggaggcagagtgctgggtggcagggcctgaggaggctgatgcagggtggggtgcattcgccagggccaaggtcctgtagagcagtgagcggcacctccacggggagaacccataaaagggccccacagggaaacagtcggtatcagtcaccagacccagagagggagacacgcagacctgcccaatgcctcttctttgtcctccctcctgtgctctcccatctccctactcctcagacttgggcaggttctgacatctcagttagcaatgacagaatggagaactgctaggccaggaaagagagaaaacaccatggcactgtcttccgatggcagtgatgtccaaagcaggtcctagctgtggggaggggagatgtaactttcatcaca

SEQ ID NO: 387091 - DNA, 177 bp, Homo sapiens
tcaaatagtagtcttagcaaaatcacacaactcttaattctctggagaaatagcaaaatcacagcttgtgactactttttaaagagtagtactttagtacaaattttataagaaaataatcactcttgggtctacagactggtgtctattaatcgttgcaaactggttttcatgatg

SEQ ID NO: 387092 - DNA, 417 bp, Homo sapiens
gtaatgggactaagaggagaattctgtatgtggttctgagaagggagcagagtccagctctttggatgttgtattaggaaatttactagagaccatgtcactgctccactcggaatcctcgggtggcttcccagtgcccttgacatggaatcaaactcctcgcttggccatgcaatccgggcctggtatcctggccccctccccagtccactgtggttggctgtgctggcctcgtggatcccaggccctccaccctcatgccccactgagcacttgcacctgtgtcccacctccagccctcaccagctgtcctccagctctcatctgtgatgcatccgtcagacctctgctcccagcctgccctctctaatctataatctcattttattctctgtgtgagcattcagactgatgctg

SEQ ID NO: 387093 - DNA, 677 bp, Homo sapiens
ccagccctgatttgaaggcagcaggtatctcttgcagctgcagcactccaacttcctctaatggcacggtcaggtcgcaggaaaccacagcggcagcgcggtgcagcttcccacgcccgcccttcgagcttgttccccagcggcgcagctcagcctcctccaagtctcagcctcataccggcggggagacaaagctggcgctgggagtgggaaaagggcccgcgaaatggcctcaagatcgtgcctttgttagaagaaacatgggtacgctccgatgcgacgcaggcttccaaccccagcggttcggtggtggtgcagtcgttgaattgcgctggccctaataattcagcctggcagggttcgcgtttattgcggagagagactcttaagcattctgtcaacacatatggcaaatagaaagcctcaaccataacattgcacagtttttgcagttcttgctttaaatatgttcacagaaaagacggccttgttttacccagagaaggagcgtaatgcggagcgaaccattcgtcacccccattctctgctgcacttaactgtgtacagtgatgataattagcctctgggtccctgaagtccctggttcagttcttccgtctgtattctagagataattatttattaccaagtttgaataaagagctatatcccctaca

SEQ ID NO: 387094 - DNA, 430 bp, Homo sapiens
ccctgcttctgcttgctctctgtgggttgcatccactgcctaaccagttccgtgagatgaactggtacctcatttggaaatacagaaatcacctgccttctgcattggtctcgctgggagctgcagaccagagctgttcccattcggctatcttggcccttacccaaatggagaattttttaaactagtgatgccaaggccccactccagactgattaaatcagcaggtctgtcctatgcatgctgatgtatttggctgaggtcataatgtctgcatcttattttccaaagcattttgtgtgtatttatatttctctatctatctatctaaatgttactatgtatatatatatgtgtattgtactgttattccacattttctgtatgtttgacatttttcaaaataaagattgagaaaaaatgatgagta

SEQ ID NO: 387095 - DNA, 740 bp, Homo sapiens
ttttctgcagcctcatgtttgactgttggagatttatcctgtgcaagagacctggaagcaacagttattcttccccacaacggcccaatgaggccaaaaaggaggaaacggatcaccaaattgatgtgtctgacgtcatcaggcttgttcaagacacaccggaggcgacggccatggccacagcccctcggcgatctcagtcccctggcttgtgacccacctgagtgtgatgattcctagtccacagctccagtccggacccctcccccgggcactgcaccgccctgcctccgcagagcctccacccgcatcctacaggtctcccagagccgcgtcatccactgcagctccatccaccatagttcactgcacctctccgtccagttcctttggccagaaaccccatcgtcctcatctgtgttttcactcatgcccgtatccgacctcccgggaaatcctgttggctgtgcctccagaacagatccagaatccagccaggctaccgccctgtctcccactttgaggtcgcgctgcctctgcgcctgtccctccccaccgccgtctcgcagaacagcaagcggtgacctctcgaaggaggcgtgattaacaaagagccaaaatggcaaactgtgtggaggccgtggcgtgggctgttcctcgagagccgtgcttgtagggctggcctgggagggcatccctggtccgcagaggccggtctgtgccgcaaagcctgggcgcag

SEQ ID NO: 387096 - DNA, 426 bp, Homo sapiens
actgcactccagcttgggtgacaaagcgagactctgtctccaaaaaaaaaattcaaagtctttaccccttgaagttactagaaaaatccaacctatgttatttcactttaaaaatatcaacttgctatgactttttcctttcaaaagctctcttcggcaattctacctttggactataagcttcttacaaaataattcatttttcccattcccgagtgtgtgcgggtctgaattttatgaatgtctttggcaagtctgagataattcagccagggttccatccatctgcttcatagacagttccactcacttggcctctgaaagcactccatgcgctccccacccacggtcagcccttacccaggtccctctctggctcccactctgtggcacccccacccccgccatggccccagcacagctgtg

SEQ ID NO: 387097 - DNA, 441 bp, Homo sapiens
actgaaaccgtgtctctacaaaaaatacaaaaattaaccaggcgcggtggcgtgtgcttgtagtctcagctgctcaggaggctgaagtgggaggatcgattgaacccaggaggtcaaggctgcagtgagccatgatcatgccactgtactccagcctgggcaacagagcaagaccctgtctccaaaaagaaggtgttggagacacagggaatttttagggaagtgaaactattctgtgtgatactctaagggtggatacatgttatatattgatcaaaacctataaaagggcttcacgtatattaacacatttcacaacaatcctgtgctgatgaagtagcagtagtactaatatctcttactgagtgcttattctgcactaagctcagagaatagatggttacatctaataaataattttgtagataatcaaacaggctc

SEQ ID NO: 387098 - DNA, 218 bp, Homo sapiens
aacttgcaacataaatactagaaaaagagaaaatatcatcaaaatacaaataactgttagaaatgattgctcaaaagaaaaacctggcaatgcatgattaagaaatgcaaaagaagatacagttgctctctgtatatgcgctttccacatccacagattcaaacaactgtggataaaaaaggatttttcaaaaccattaaaaaacaatgcaacagtaa

SEQ ID NO: 387099 - DNA, 406 bp, Homo sapiens
caaaagaacaaaaatgtagtttttgattgaatactaagatcagactcatccacctgctgagcaggtctgaataccactgcacatgcaactgggcaagcatagtcaaaggaggcttgattaagcaaaacgaagctgagacagctccagcctctcccttgccccaccctgtccatgcgtgcagctccccctccaggagatttgaaagggacagggtggggtggtgggggaatggatagacacaggatgagcaggtgaccaaggaggcttattctcaatgatgcctgatgagaagaaacacccagacttgtagctctgaccacacaatacgtcctcttaggatacattctttctcatttattccccgtgtcctcacgtccacacctgttctctcacttttgcatccttc

SEQ ID NO: 387100 - DNA, 763 bp, Homo sapiens
actttctcaaaataaatttatggtagattttctatctggtcacaagtgaggaggtgaaagctgctttttggggccaactctttgcttttaaagcaagctaaacgcaataccagaaaggtttccattctgtacttaacctgcttgtccttctcactcttccttatcctcccgcacacgctctgagcattgactgagcactctgaggaggaggctgactcaggctgacccttcccggccctgcaaggctctaaggtagaaccagtgttatcacaggaaaggcccaagccaaagctcagagcagctgttcctgagaaagtgggagatgaggatgagtaggaggtagagatgcttataactgctctgcccagagaaaactcagaaggtgcagaagagttttcaaaataaagtgcaggccccatcaagtaaaaaatgaaacattgtatttcattaaaatggtgatcagttttctcttttcataaaagacattcaaatggtgagattgtaaaaaaaaaaaaaggaaaaagaaaactttctaattctcaaaaatagaacagcttgaataataactcatgggttttgaaatgggtcatcttttaaaaggggtcactttggctagaatcattgcacttggtgactttcacattgtaaagggtccagttctttctgaggcccaattgcactagaatctgcatttcagaacacaggaggtatcaggaagaaactgggagaaattcagagggaaattgtctcttctcagagtaac

SEQ ID NO: 387101 - DNA, 574 bp, Homo sapiens
aggtctctctgcaaacaatcccatcacccctaccaatgagctttgcctctactcacccatctgagctccagccttcgcgtgtgactccgaacggtggagttttctcctaaatccattcatcttgccaaaacactgttcacaatagcaaagacatggaatctactaaatgcccatcaatggtagactggataaagaaaatgtggtacatacacaccacggacaaccatgcagccataaaaaagaatgagatcatgtcttttgcagagacatggatggagctggaggccatcatccttagcaaactagcacaggaagagaaaattaaatactgcatgttctcgcttataagtgggagctaaatgatgggaacatatgggcacatagaggggaacaacatacactggttcctatcagaggatggaaggtggaaggagggagaggatcaggagaaataactaatgggtactaggcttaatacctgggtgatgaaatcatctgtacagcaaaccccatgacacaagtttacctatgtaacaaacctgcacatgtacccctgaactgaaagtaaaagtta

SEQ ID NO: 387102 - DNA, 578 bp, Homo sapiens
ggctggaggtgaggaggcagcacgtccctttactgtcctgttctgctgaggtaggaaatggtgcttcccaaccacaaatcccggcaggatgagggcagggagagatcagggtgctggcactcagattcaatgggtttttgctaaatgtgctgtccgccacccactcttgcctttcttctagtgccctggctggtgctcagcgagatctttcctggtgggatcagaggacgagccatggctttaacttctagcatgaactggggcatcaatctcctcatctcgctgacatttttgactgtaactggtaagaagtctttgttttcctctaatgtctttggtcctcgtaggacaaatgttagggaatcacacccacctaaagaccattttttcatggaaattttcaaacacacttagaaggagaacggccatgaccctgaaatacccatgacccaatttacagttttgaatgtaaatctatttataaccccacctgctcttcccctacccaattattttgagtcacatcccatatgcaatgttgttttttctgaaaaatttcagcatagacctttgacatt

SEQ ID NO: 387103 - DNA, 467 bp, Homo sapiens
ctggcactcagattcaatgggtttttgctaaatgtgctgtccgccacccactcttgcctttcttctagtgccctggctggtgctcagcgagatctttcctggtgggatcagaggacgagccatggctttaacttctagcatgaactggggcatcaatctcctcatctcgctgacatttttgactgtaactggtaagaagtctttgttttcctctaatgtctttggtcctcgtaggacaaatgttagggaatcacacccacctaaagaccattttttcatggaaattttcaaacacacttagaaggagaacggccatgaccctgaaatacccatgacccaatttacagttttgaatgtaaatctatttataaccccacctgctcttcccctacccaattattttgagtcacatcccatatgcaatgttgttttttctgaaaaatttcagcatagacctttgacattca

SEQ ID NO: 387104 - DNA, 2654 bp, Homo sapiens
cacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtatttttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaatggcctcaacaccttctgaacgtggatagtgccagaacacttaggagggtgtctttggaccaatgcatagttgcgactcctgtgctctcttttcagtgtcatggaactggttttgaagagacactctgaaatgataaagacagcctttaatccccctcctccccagaaggaacctcaaaaggtagatgaggtacaaggtcctaagtgatctctttttctgagcaggatatcaggttaaaaaaaaaaagttactggctggtttaatactttctaccttcttcacagagcagcctttgaatagactatgtcctagtgaagacatcaacctccgccttaagctatgtatgtatggaggccagtcgcagctttattatgcagacacacaagtggtctggacatgagggtacagtttctgcctaccaagacactacttgcactggatcttacgcaaaaaagaaccagaacacacagtgtggacaactgcccatatattctatctagattaggagagggtcctggctaggattttagtggtaattcctagttacattcaacaagtataaagattatagagcttattttatgaactataaactataatttaatgcaaaatatccttttatgaatttcatgttaatattgtgaaatattaaaataattccgcaatagttgagaaaaatgagcatttttttccatttttaaaaaatgcatagaaaagacaattttaaaatcctgggaccatatttatttagaagtagctgttagtaaaacattagaaaaggagtcaggccattaggttatttatccaaatctctaagcaattaggttgaagttattaagtcaagcctagaaaagctgcctccttgtaaggctttcatgacaatgtatagtaatccacagtgtccaattcttcacactcctcaggaatatcactacctcaggttacggtacacaggctataattgatgatgatgttcagataactgaagacacaataaatgacattcagacatcaggacaattccctcatgttcttttctatgatggccacctgtaccagcaacgtgggtttcacccacacaacgatgaactgttctcttacttctccagttgattttaaagacttgttaagaggtcttactaataaaatttgggtatgatagaaaatccacaatcaaatcttgaacc

SEQ ID NO: 387105 - DNA, 310 bp, Homo sapiens
gacttttataaaaataacaaataaaacatttccctcctataaattttatggtgctattgcattgctggtaccctaagtgcatgtttagtgtgtctattgggtacattggccatgggaataagaaatcaaaaatgacaccaatgttttgcatctaattgaccagaaaacatgattatatagttgccagccaaagactggttttagagagaagcagataagtttagttgaggttgaattaatgttgaggtgctggcagactctccagatgaaagagtaaagagctccagaaagatgatttgggaattcatct

SEQ ID NO: 387106 - DNA, 521 bp, Homo sapiens
ctcgcgaacgtgttatccctctgtcttcccaattagaggccagcttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacttcgcgagggtaccggctcgattcgtatctgtct

SEQ ID NO: 387107 - DNA, 935 bp, Homo sapiens
ggtaatttaccacacaaagtgaaagcacaggtaggggactattaatagatacttgtaggaatatctcttcctaataaatgtgtttatttgtaggctttttcatatctaaagcaatagaatatttgatacaatctcagaaagcagggaccagattagtgttcgtgtgtgtgacatttatgtcactcctgtagtatactaatggaatttagaatagtactgccatctctcaggtgaatagaaacattgaacttaataagcttagccttcagtttgtcctaggcattcattgcaaacctgcttgtgctaatgaaggaattacaaatgaaacatcaagatttttagggaattctggattatagaattctatattatatgtgatttttatttattatggtggctgtaataattctataggtcttttgtttcagtacgtggaacattcatatatttggaggtgcattctttgtaacttttttcttttgtaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaaggtgtgttatagggttttgctttgtttttgaggttagactttttcattttttacaacccatttttcttctactctgtagtacacattaaatcttctattgtctctttcttgttaaatagggaatggtgagttatttaaataaaaagtgctttgtgtacactgaaggataaggttagaagaaactgttattggttggattaaagccagtttcttccattgtgttagtatttttttcccccctagaatctccctgtggttggcacactgaaaatactatctctggcagc

SEQ ID NO: 387108 - DNA, 267 bp, Homo sapiens
tctctggactagcaattgctgtgctggtacatggttcttcctcagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387109 - DNA, 298 bp, Homo sapiens
acacacctgattgctcatttctaatttggtgccaggcgcccaaacaaagagcctcagggaaacgtggcagaagaagaagaaacatctgtgaagaagaagaagaaaaggggtaaaaagaaacacattaaggaagaaccactttctgaggaagaaccatgtaccagcacagcaattgctagtccagagaagaagaacgaacagaacgcaaacgacaacgagagagcacgacggaatcaccatgcaaggaattaccgatagtatccccccggatacacgctcgcgagggtaccgagctgag

SEQ ID NO: 387110 - DNA, 180 bp, Homo sapiens
gcagccgttgcgttcttctcagtttgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaaacgcaaacctg

SEQ ID NO: 387111 - DNA, 2043 bp, Homo sapiens
ccagtagggccgggtgtgaaatcggacgagggtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387112 - DNA, 2058 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaagtgaaaaaaaacatccgaaataaaaaaa

SEQ ID NO: 387113 - DNA, 1779 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctgtatgtttgtttttaattatcggtt

SEQ ID NO: 387114 - DNA, 2161 bp, Homo sapiens
ccagtagggccgggtgtgaaatcggacgagggtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagggctggttttccccatgtgtgaggagaggtgagaagtggttaagttgatctccctgtggaaaccagcaacataatgctgaagcacaattcagtaaaaggtgttctacaagggaccaagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387115 - DNA, 2084 bp, Homo sapiens
ccagtagggccgggtgtgaaatcggacgagggtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaagagtaaagctaaaacattttgagaaatttcaggatacagcagaagcattagcagggctggttttccccatgtgtgaggagaggtgagaagtggttaagttgatctccctgtggaaaccagcaacataatgctgaagcacaattcagtaaaaggtgttctacaagggaccaagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387116 - DNA, 1695 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggtgatggttttaatgtaatttgtaaatatgagtgtttgaagtattttctggttaggattttgtttacatctttaaactacagctgttaaagaaattttagctgataacacaaaagtagatgatatgtgggagatcactaagggccaagtgttcaatgatgatttctatttgtttgcctgatttccttttggataatgaaggcatctttagtcactacctcttctgagacacttgtggtccattgttagaagtttgttagggttaattagaacaatcggatgaatgcaggaggataaaacagttaacattttcataataaaaactcactagacctagatttgaatacagttttaagaaatcactgtagagaaagaaaaaaaaaaaaaaaaaaaaaatgcaagcataactatttttgtgcattggttacttgaatataagcactgcagtactgcacaacggagagggctacgaaagtgactaatgggtagatagagatgattcatgtcctggggggagctgagtgggatagcaagagatttaaaacttaggaactatttatttctggaatttcct

SEQ ID NO: 387117 - DNA, 1872 bp, Homo sapiens
ttctaaatgatgtcagagttcaccgtgggatcgagtgataggccagttgtgcacaactcggtagtattttcccgcattgctgtgcccaggttcaatattattgccactgtagtgatggacaccagttttagcctacatagcatagtactctatgttcagatttcctcaaagctgggcagttgttagcgagaatgaccgatttcgctttgccttgtctgatcatcgttcagagtctgcttgtaccccaggacgtacttcccactgtttcatgaacgagttggagcctagagttgatcgactccagcgactttttcgtcttctttgcggccaccatcttcctgccttaggagcgggacggcccccaaccaacagcagccgctaagatggccggttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387118 - DNA, 1581 bp, Homo sapiens
ggctgcagtgaattcggcacgagcggcacgagagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387119 - DNA, 1081 bp, Homo sapiens
  misc_feature (22)..(22): n is a, c, g, or t
cccgggaacgaggcagagaagntgcatattctgctctttgcacccagtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387120 - DNA, 749 bp, Homo sapiens
  misc_feature (31)..(31): n is a, c, g, or t
caggaggaggctgggttaatcggacgaggancgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387121 - DNA, 1579 bp, Homo sapiens
tgtttggagacagagtctccctctgtcgcccaggctgaagtgcagtggcgtgatcttggctgactgcagcctccgcctccggggctcaagcaattctcgtgcttcagcctcctgaatgctgggattacaggcgtgagccacagcacccggcctccttcaagaattttaatagtaaaatcttataagtggatgaggagagtaattaatatatagaacattaccaattataaatacatatttaagtataatttagtgttttctggaaagaaatcaaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttattgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387122 - DNA, 1675 bp, Homo sapiens
tgtttggagacagagtctccctctgtcgcccaggctgaagtgcagtggcgtgatcttggctgactgcagcctccgcctccggggctcaagcaattctcgtgcttcagcctcctgaatgctgggattacaggcgtgagccacagcacccggcctccttcaagaattttaatagtaaaatcttataagtggatgaggagagtaattaatatatagaacattaccaattataaatacatatttaagtataatttagtgttttctggaaagaaatcaaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttatgtaagtattatctaatggcattttctttatctcttgagaattatttcaattccagatacttgttagagattttctaaaactttttgggtctttcagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387123 - DNA, 810 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacaggtgagaattactggaaaataaagtcaacttacttttatttgataagcgcttaacatagatctgttctaagaatgttacaaatgctcatttgaaccacatcagaaccttatgaagaagatgatagtaatatcctcatttacagatgaaactgaagcccaagg

SEQ ID NO: 387124 - DNA, 583 bp, Homo sapiens
ctaaattcgcggccgcgtcgactatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387125 - DNA, 1351 bp, Homo sapiens
tgtttggagacagagtctccctctgtcgcccaggctgaagtgcagtggcgtgatcttggctgactgcagcctccgcctccggggctcaagcaattctcgtgcttcagcctcctgaatgctgggattacaggcgtgagccacagcacccggcctccttcaagaattttaatagtaaaatcttataagtggatgaggagagtaattaatatatagaacattaccaattataaatacatatttaagtataatttagtgttttctggaaagaaatcaaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttattgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggat

SEQ ID NO: 387126 - DNA, 692 bp, Homo sapiens
gatatttgaaatccgatacacgggactttcagaatcccccaacagataccacataaaaaggtcttcatagcacattatagatccaattgtctaaaatccaagaccaagaaaaaatttttaaaaccaaaagaggaaaatgtttgggcacctaaaatttaaaaaaaaaaaaaaaccatcagactaacaatgagtttctttgcagaaaccttactgaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387127 - DNA, 1369 bp, Homo sapiens
tgtttggagacagagtctccctctgtcgcccaggctgaagtgcagtggcgtgatcttggctgactgcagcctccgcctccggggctcaagcaattctcgtgcttcagcctcctgaatgctgggattacaggcgtgagccacagcacccggcctccttcaagaattttaatagtaaaatcttataagtggatgaggagagtaattaatatatagaacattaccaattataaatacatatttaagtataatttagtgttttctggaaagaaatcaaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttatgtaagtattatctaatggcattttctttatctcttgagaattatttcaattccagatacttgttagagattttctaaaactttttgggtctttcagtgaagtgaagacttacgatccttctggtgactccacacttccaacctgttctaaaaaacgcaaaatagaacaggtagataaagaggatgaaattactgaaaagaaagccaaaaaagccaagattaaagttaaaggttagtttgaattttttttttaacacaacttatactcacttctttagaactgtggattttgtgagtcttaaaagtacatgccatcccactttattataaaactgctc

SEQ ID NO: 387128 - DNA, 789 bp, Homo sapiens
agggtaaatacaatttttcagggttgcagcaggtagattaaacccaggccgtctgacttcagagtgcaagctcttaaccatttctaatataattgactttcttcccaataatgattggagatcagatgacctttgttttaatcctgatttttatacatgacttcatgatcgtgagaagattgctctgagctctatctatatcattcgttaaagttagtggtaggccttggagaaccttcccaattataaaataaacaaaacaaacattgggtagttgatgagaatgacagaaaaaaactaggactcaaacgtttttggaaggaatgagatctgatacagtgttaatttgttgtgcctttacacttaccctattcagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387129 - DNA, 1463 bp, Homo sapiens
tgtttggagacagagtctccctctgtcgcccaggctgaagtgcagtggcgtgatcttggctgactgcagcctccgcctccggggctcaagcaattctcgtgcttcagcctcctgaatgctgggattacaggcgtgagccacagcacccggcctccttcaagaattttaatagtaaaatcttataagtggatgaggagagtaattaatatatagaacattaccaattataaatacatatttaagtataatttagtgttttctggaaagaaatcaaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttattgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaaggaaggaagacagactcaagaaaacaaagactccaaacaagagagaagtaaaggatgacagctgtgcacagtaagttcaaagagcaatcagtagggactacagcaggaggtcagaggcttttagaaggaatgttttcacaggaaaaaaaggaaactaaaaatgcttctgatttgaatagaaaatagtatctggagagttttacaactatgttggagacactaggaagtatctgtaatagtatcataattatataaccagaacaccgtcgaaggggatcctcta

SEQ ID NO: 387130 - DNA, 421 bp, Homo sapiens
gtggctgtctagaggtcccctctggatgcaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387131 - DNA, 343 bp, Homo sapiens
ttcgaactagtaatttgaccaaaattacatgcagggtaagaaaactagttcattatcttagtgaaagaaatagcttctacaccttcattttacatgtaaaattgtatttgaagaatgcagctgtatatgcctcacctgtaccatttaaataaaactatttaaacattttattacaggttctaaatgagaagaaacttcaagaggttgatagtttatggaaagaatttgaaactccagagaaagcaaacaaaatgtaagtactcttgaaatcaataatttagcagttaacatttagggcttgttttattttttacatttttccctgatttatataatgttacat

SEQ ID NO: 387132 - DNA, 543 bp, Homo sapiens
gtttttactcatatgatatttgtgacttaactttattccttatactaggtgattgaaatctctgaatatcgaacccagctctatgaatatctacaaaatcgaatgatggccattgcacccaatgttacagtcatggttggggaattagttggagcacggcttattgctcatgcaggtgatggttttaatgtaatttgtaaatatgagtgtttgaagtattttctggttaggattttgtttacatctttaaactacagctgttaaagaaattttagctgataacacaaaagtagatgatatgtgggagatcactaagggccaagtgttcaatgatgatttctatttgtttgcctgatttccttttggataatgaaggcatctttagtcactacctcttctgagacacttgtggtccattgttagaagtttgttagggttaattagaacaatcggatgaatgcaggaggataaaacagttaacattttcataataaaaactcactagacctagatttgaatacagttttaagaaatcactgtaga

SEQ ID NO: 387133 - DNA, 716 bp, Homo sapiens
ccaaagcctatgactaggtacgggctgggtttgagtgcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctggctcgaattagattgaagtaagcgctgataagtcaccatgatggccgcaatcctggtaatgactggataaaactaaa

SEQ ID NO: 387134 - DNA, 2030 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387135 - DNA, 2278 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaaaaacaacaaacacaaaaacagaaacgaaaaaaacaaaaagaaagaaagacaaaacagaaggaaccagaaccggcagaacaaagaagaaaagagacagaggcaaaccaaaagacaccaacaacgaacaacaacgcacgacccaaccaccagaaggcaggaagcccgacaacaagcgacgagaacaaaacagcacgacaaaaaaccagggacagagaaggaaaaaaaaaaggaggaaacaacgagcaaaa

SEQ ID NO: 387136 - DNA, 2016 bp, Homo sapiens
tccgctggtcgaggccggtgttaaatcggccgaggcgcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387137 - DNA, 1990 bp, Homo sapiens
ccagtagggccgggtgtgaaatcggacgagggtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387138 - DNA, 1572 bp, Homo sapiens
agaatcctgagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaaggtgtgttatagggttttgctttgtttttgaggttagactttttcattttttacaacccatttttcttctactctgtagtacacattaaatcttctattgtctctttcttgttaaatagggaatggtgagttatttaaataaaaagtgctttgtgtacactgaaggataaggttagaagaaactgttattggttggattaaagccagtttcttccattgtgttagtatttttttcccccctagaatctccctgtggttggcacactgaaaatactatctctggcagc

SEQ ID NO: 387139 - DNA, 1731 bp, Homo sapiens
cccacctcggcctcccaaagtgctaggattacaagcgtgagccaccacgcccagtccaatatgacttttgtattacacagcttatcctatttgtcattcatacataaactcattcatgttacagaaataaaggtcgtagcagcacatatagtttttttttttaatgtgtattttctgttctcgtatggtgcatttctacttagctgatttttcttcttagaaaaaccaattacagctctgactacaggctgatttgagtaaaaacaaaaacaaaaaaaaactttaaggtgttaatttaaatgcttttcctagatgctatcttgctaatttattttcccctttcttcccagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387140 - DNA, 1120 bp, Homo sapiens
gattacaggcgtgagccaccgcgctcggccagaacccgcacatatttaagattgttacgaggaaaaagatgcacttcttttcagtgacctcatagcacagaactaatgtcactgagtagaaactaaagtttaaaaatattttttaaaaaaacctagtttgagctaatatttgacatgaattgctgtaaaatcttttcagccacagaagtgttggtggtgatatatggccattagattgtggcaaaggttgaaatacgatggatgatttgaattgtatgattcataatagttttataactcctgattttaaaacatccaagttattgaggattttacatctgaacatggaatatagttcttcatgtttttctattagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387141 - DNA, 716 bp, Homo sapiens
gcggactactactactaaattcgcggccggtcgattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaa

SEQ ID NO: 387142 - DNA, 683 bp, Homo sapiens
cacaaggcagcttgcttcatcagagctagcaaaaaagagaggttgctagcaagatgaagtcacaatcttttgtaatcgaatcaaaaaagtgatatctcatcactttggccatattctatttgttagaagtaaaccacaggtcccaccagctccatgggagtgaccacctcagtccagggaaaacagctgaagaccaagatggtgagctctgattgcttcagttggtcatcaactattttcccttgactgctgtcctgggatggcctgctatcttgatgatagattgtgaatatcaggaggcagggatcactgtggaccatcttagcagttgacctaacacatcttcttttcaatatctaagaacttttgccactgtgactaatggtcctaatattaagctgttgtttatatttatcatatatctatggctacatggttatattatgctgtggttgcgttcggttttatttacagttgcttttacaaatatttgctgtaacatttgacttctaaggtttagatgccatttaagaactgagatggatagcttttaaagcatcttttacttcttaccattttttaaaagtatgcagctaaattcgaagcttttggtctatattgttaattgccattgctgtaaatcttaaaatgaatgaataaaaatgtttcattttacaagagga

SEQ ID NO: 387143 - DNA, 272 bp, Homo sapiens
aattcaaatatatacttatctatactgataattgtaaaaagtaattattttaagttaattgaaaattctgaaaaatggctaattatgtatttaatgattaagagtggctatgcatatatttgcatttttaaaatattgatttaaggattcttaatgtgtttttacaacatgtaattttgagaacaaattgtgtacagcagaaaacatttggtatcataataattaatctgatttctttacaaacacagagcagaagtccactggtaaacatt

SEQ ID NO: 387144 - DNA, 434 bp, Homo sapiens
ttctcctaacacactaccttcctttctggctctaagattttgaacatactatttattctctttactagtattatctgtctaattcattccttaaaatacaactcccataaaatctccttgatctccttccaacactctcaccactttctgtaccctacaaaaatatatattgttttacttgtcatattctgtagaaagctacttttaactacttacttattaatcaggtaagttttgcctatatgcagagaatttacaaccacaatctttttacctgtgtatattacaaggcccttggaagtcacattttcggccaggcacagtggctcacacctgtaatcccaacattttgggaggccaagaggggaggattgcttgagcccaggagttcaagaccagcctgggcaacaaggcaagacccccatctccacaaa

SEQ ID NO: 387145 - DNA, 691 bp, Homo sapiens
ctatgctatctttttcccagaagcattaagtttgaagactcaatcaccaagtgcaatcaaagctacctttcctccccccaaaattaaatagacatttttaaacacacatacacatttcaagatcaacagagttcccttttgagcatggaaatatagccattgctaaattacgttactggactgaactccaggtattagttacagtggaaagtaagagattgtaggagactcttttcttagaaccaggacatggattatggcctggatttaattaactgttgctcatggcaccatgcaggctgacatttaattatattcagtttagccctttattatatatcctctcgttattctccaaatgttctaaatatcctggtcttgttttatctagctctgttgtaagctctttgaaatcagagctaatgtcacacagtacatactcaataaacacattataaatgaatttatgagcaaagaactaaatgaatgtggctacaaattcgagatgctactgttcacaatacaagatgcgaccttaacaattcaagaaaagtgaacaactgaaggtgagggggtttccctgttgttccctgaaaggcatccaaattctcctgaagctcccatgaataagatggaggtttaatttttctctctttggtcctctgctcttttaatctgctccagcaaaaaa

SEQ ID NO: 387146 - DNA, 643 bp, Homo sapiens
gtgtttatgaaagagggttaaatcccacaaaaagataatttgaaatggattcactggtttggttcccttctggcttgtgccgtaagcaggacagtgacatggacccaacgaatggggagcactaccatgcccagaaatccaggtactggcacactcagccaagcagcaccttctactgctagaaatgggggagacgcaaaggtaagttcacaattgagaatcactaacatttgagaaaaccaacactacatgaaagaggcataaaactcaacaaacaagaatgaacactggagcaaagaggaatacttttaagagtatcacagtcaatatcttcagagtgataagagagagtattgctatcctaaaactagaatgggctgttatgaaaaataaccaacagaaaggcagaacaactgcatggacagcgctgaagaatacatctgtgagctgaaaattcagctgtgaaatcctcctagaaaccagtgtaataaaacaatgaagtgaacagtatgaaaacaacatttagagttctgaaggatatatccattactcaataactccaatatccatctaagagagtttctagaaggaaaaaagttcaacacacaaagtggttgtagaagaagaatttcaagaaatgaac

SEQ ID NO: 387147 - DNA, 443 bp, Homo sapiens
gctcaatatatgattctgggaaagacaagcaattacaaaacagtataataagtttgagagaaaacgtaggcagtgggagcacctaagccagactgtggtgggatgggaacatgggagatgaagatagagaaggttttcaaaaggtgatagctgaactgagtcttgaagtgccaggaagaaacacattgtaagggtattttatttagagggactggcatgtgcagaggctcgaggtctgagagcatggggtgtttggggacttgtaggtagttcctgtgggactaaggcatagggactgatgaagcttgaacaagatcataactgccttctaggggccatgctctggagttatgattttaaccaaagatgatggggaaatttggggagtgatgaaatcagattttcatttcagaacgattagtttgacagcattgttgtgtatg

SEQ ID NO: 387148 - DNA, 590 bp, Homo sapiens
tctcctcactgctaaagataaattgtttatctgtataacataactacaccaatgtcatttttgtatacgctagtacacaaatgtgtttttttattaagtaatgaagtatttgctgtgaaaaatgtattatttgtgccaccgtttatatctgtgttcattttctgtgtgtatatgcgtgtgtattcgaatctcaatttttcttttactctagtttagattaagacatatttagatgaaattttaaaaataacattggaaataggaggctaagttttgttcagtctcattcccttggggggaaattgcttttgccattttattttcatgtacaataacctaaaaaggatctcctactgacttccttcctaattattattgttttacacgaaagaaaggaaatacgttttcaattgagttgtttgaaatcattcactttgtgtagatttcccagactgatgtttcattgtaagaatattacattatagacaggttggccatttcacaagcaactaatccatagttttggaagcccgctttaagagacctgaatatctttgtttttaataaaatacttagagtttaaaaaaagc

SEQ ID NO: 387149 - DNA, 449 bp, Homo sapiens
ggatctagtgggtagaggccagggatgcttctaaacatcctgtaaggcacaaaatagcccacagtaacaaagaattattcaacccaaaatgtcaatatgcaaatactccatatgttcctgtagaaaagcatgaacaaacctataatttaaatccgaaggaatctctggcgtctaaaacttcacaggtggaatgcaaagtaagggcaggagactaagccaactccaagatggccgccaatgatccccacttcctggtgttcatgtctttgtctaattccttttctgtgtgggcctgatctattgactcgcttctaatgaatagaatatgtttaaaatgatgtgatgtcacttttgagattaagttacagaagactccatgttgggagttgtgcctcaccctcttagatcatttttccctggggaaagccagctgtcatgatgtgaggtag

SEQ ID NO: 387150 - DNA, 98 bp, Homo sapiens
aaacaaccactccatctcccaaccccctgacaaccaccattctactttgctcctataaatctgactactctaggtacctaataaatggaatcatatgg

SEQ ID NO: 387151 - DNA, 359 bp, Homo sapiens
agggtagcaagggtgggatggttaggggcctttctcccttcccaggtggactgtctgagggcaccagagtcaccctgctcccatagttatcctcgcctccaggcggaagggagggaaggccttggaacatttcctctccccttcccccctctgcagttgcagtttccctggccccctcttggcatctggaaaagtttgggaaacttaaaaaaaatatttttggagagtttgtctattgctccccagccctgtgagggagctacagccaagaggaagaaggaaaaggagtgggttggggtgactaggggatagagagtaaagtcaaagagaagcagagcactcggaaaaagggcagcacc

SEQ ID NO: 387152 - DNA, 227 bp, Homo sapiens
aatgagttacctgacaaataggtgaggtaaggtattgcacagcttcacttgggaacagccgcctgagaggcactgggagagaaccccttctgcaaagctaacagctgtgaacctaaccccagtgcacaccctagctgggctgctgacttgaagctggcagaacaatggaaaactgcaccaccaccaagggggcaatgtcagatcgccaggatcacacagtcgggcgc

SEQ ID NO: 387153 - DNA, 483 bp, Homo sapiens
atagaaaaacatgagttgagggcctactgtgtatatatacataacatatatacatatatagtgtatatacattcactgtatatatgtgtgtatacatacacacgtacacatgtatatctctctcaatatatatcaggtactcaatatatactgtctcccttcttccataccatatctcaactgtagggtgactaattacgtttgttttttattccttctgatttattattaatgagtctattttgacagcaatataaaagaaaatagcctcgtttttttgtaagagcttacttcactttcccaggacataagagaacatcaatttttgatgcaataggaattcagtagcaaaatagatgtctcaaaatatttacttcttgatggctggaaacatattttcagcattctttagtacagggacatggatttgatgttctatgagactacatccacttcagaatgtatatatatatggccaaaaaa

SEQ ID NO: 387154 - DNA, 856 bp, Homo sapiens
tctgttcctttgtcatctataccattttcttagtttgtagaaaactggcctgcttctgtcttgggaccactgcaagggaatgttattccccagcaataaagtaggtcagagccagactggagacttgcattcctgtgtggttgtctccattgtcaccactcaagtctcagggattgctcttcctaaaaccatgtccttgggagcaaggctttgcccattgttttctcttctcttctcttctctagcagaaggtctctaaaggctactatccctagaactggccatcttcaggctgaagctaggttgggctaaaatgatcagccttcagtagaaatcaaggctgaaacaggtaaaaagcaggctgtctgagcatttccctaccagagacccttcagctaagtgtctgggtatactcagtcaaacaccatccctgcctttgtgttcatattctgtgtccctattcaagaaaggtagttttctttctttctctctttctttcttttctttctttccttttctttctttcttttctctctctctctttcttcccgtctttctttctctctctttctttctttcctttctttctttttttttttttttgagacggagttttgctcttgttgcccaggctggagtgcaactgcgcaatctcggctaaccacaacctctgcctcccgggttcaagccattctcccgcctcagcctccggggtagctgggattacaggcatgcaccatcatgcccggataattctgtattttttagtagagacgggatttctccatattggtctggctggtctcgaattccaaacctcaggtatccacccgcctcagcctcccaaagtagtggg

SEQ ID NO: 387155 - DNA, 1782 bp, Homo sapiens
aaggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttctaaaaaaaaaaatctatcatttaaaacaaacatttgtatatatacatttgtttatatacatacatgcttccattctacaaacactgaaagaatattttattatgggaaattccatacacccaatacccctggtgagtcccatatacccagtaccctgttcaacaatcattaactcatggccagtcctgcttcatctttatttccatttactttcttcatgactcttattttgacgcatatactagatatataatttcatctataattattttagtatgtatctctgaaagataaagacttaaatgaccacaatactattatcactgcaatagatttatttttataaaactccagagggaaaggttgttattttttctctatgttgaattaaatgctaaatatctaattg

SEQ ID NO: 387156 - DNA, 1397 bp, Homo sapiens
aaggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtcccttcttagcgcgcccctgcgcccacgtccccacacgagccctaatactctatcctgaccccgctccatccactccgcctttcaccccctccccttctcgccctctactctccctccttcctcctcacctcttctccc

SEQ ID NO: 387157 - DNA, 1249 bp, Homo sapiens
aaggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcgggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttcta

SEQ ID NO: 387158 - DNA, 874 bp, Homo sapiens
  misc_feature (27)..(27): n is a, c, g, or t
  misc_feature (38)..(38): n is a, c, g, or t
ccggaggggaactaaggaggggaaagnaaagtggaganggtcccactccatggtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttcta

SEQ ID NO: 387159 - DNA, 1131 bp, Homo sapiens
gaactcctgggctcaagtgatcctcccagaggaccttttgggaggccttgtcctccaaaagtagtgggattacaggcatgggattacagccgccatgcccagccaatagttatcttcttcagtacagtcaagttcccaacaatgagtcatcgctctagcattctgaagatgaatttgtatttactggatttcacagttcatattctgagttgtgccattaattcagtttcaactttaacttgatgaaaactctcctggcttcctctagccctcacaacatgtgctattctaaacgtgattatattcctgtttggttgtgttttattaagatcaaaagagaaggcaattttgaattttgtaaattttcttctttccccaggattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttcta

SEQ ID NO: 387160 - DNA, 1375 bp, Homo sapiens
aaggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttcta

SEQ ID NO: 387161 - DNA, 1986 bp, Homo sapiens
aaggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcgggtgagtagtcttggaggccggcttagatccgtcatctggccaagcctgtgcgcttttgtagaggggacgaggaagccacaccactgcgtctgacagaccaacagagcaggatcatctgagaggaaagctctgttcggtggtactcaaccctggcagcacattgggatcattctgagaacatttgaaaatataactgttcactccagcccctctcccacccacatccaatttaatgtatctgggttaggtttgggagtctccattactaacaacctccctgctccgtgattccaacaaattcttcattttacctagggaaatatgtagagctagagacaggaagaaacttgtctagtgtcagtaagagacctggttcactttaaaaaataataatcttctgtcagaatctgtttgagtgaaaagaaaataatcatctgtttttgggacttctgggggaaaagaataaaaagaaaataaaaaaaatggcaaacttttgaaagtctacagtgtggtagttcagccagttgatagggaatctgatgtttaagtgccctggaggtgcagaggaggagagaggaatgcagtttgtgggtctccagggggtgcctcatgtagtaggtgacacctaaactactgtttgaaagccagacaactaaaggagttagagaaagagatatccaagcaaagggaacaaattcaaagaaagagaatttgtattagggataagagtccagcaaatagcttgctgcagttggagcagagaaagagaaaagcagcccctgtttcaccatggagtgacctgacagctaggccatggtttcacaaaatcccaaaatcactctgactgttgtagtgagacaaaacaaagaagacttttcaaattacaagaatgaccacatatttctttcttctgactaacaccagtgactgttattaacaaatacagcattagtctcactccgttacttctgcctcctatataaaaatgtaagatactgggccgggtgcggtggctcacgcctgtaatcccagcactttgggaggccgaggagggcggatcacaaggtcaggagatcaagaccatcctggctaacacggtgaaaccccgtctctactaaaaatagaaaaaattagccgggcgtgctggcgggctacacgggaggctgaggcaggagaatggcatgagcccgagagtcggagcttacagtgagtcgagatcacaccactgcactccagcctgggcgacagagcgagactccatctcaaaaaaaaaaaaaaaaaaaatctaagatacctaattgtagaaagcccctgctttctgacagtacccaatccacatccttaaccctcccctcagtcacctgatacaaacccaaatcctggaacaagcccttcctaacaccctgtcactcaaatgcccacggttccccgtggtttgctctcttctgtgcaacagactcaactttgttgaccgtaggtatgttcttggcgtctttaattgcagggcttttccagggccaagaatatactagggatggtagttgggaggagtatctctctttgccgagggaaagttaatctaataaacaattaaaaagacatgcttaaatatttagagtgattgtgtaaggaacacatgtctggaaattaggaggcggggcttcctggacaaactgccaccagcttatgacctaaggaatgtctaactcaagttttccttaagacgatacactcattttgctttatgcaattaagtttatttaaaaatagactcttctccctgctaccccagctcca

SEQ ID NO: 387162 - DNA, 1515 bp, Homo sapiens
ccaccgtacaccgggggttttgttggtgagggttccggggagcggcctggagagaggtggaggcgaagtctagtttcgcttcagggaggctcagacactgtggggtcaagtcggcggtggaggccctaggcccagcctgtggggaccggcggggactcggcctgggcagtcctgggagaagctgagccggctctgcctgaagccagttctccttgtcgcaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttcta

SEQ ID NO: 387163 - DNA, 547 bp, Homo sapiens
aaggttgacggaagtgctctatcttgttgccggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagtagcagagaaagggaaaaaaagtggggatgaggaaggtagaggaaaagagaaagcggccaaacaatggtttggttgggctgtgtttcagagtataccaccctttaaaattctgatcaaatactcttgacccataaacccttagcccttgttctgatggggtagccacaggagtccaccagctgggaatcatccactgagctctggatcagagcattctagaggctggaatgtcgggggagttttaggggtagttttccggtcattcctaaaaccatccgtcctaactcccaggcaggtttaaatagtgcaaactcttaggcagagag

SEQ ID NO: 387164 - DNA, 235 bp, Homo sapiens
ctccacctgctccactgctccttggcaatctgtttcctaccttcagaggcttggtttctggccagtggctctttctcctttccccactggtctttctttaatctttttgctacaactttaatggtgttttgagagggagtggaggcaaacacgtatcatctgctctgcttaatgcaaagtatgcacaaattctctaatgagtgattgtgggggacaataaaacctatggttataa

SEQ ID NO: 387165 - DNA, 694 bp, Homo sapiens
tgatctcactgccactttccattccccaggcatgctacttgtctgctaggcctctgaaactccttagccccttgtatgctaccattttcaagggaacaaagggaaagaaaaagaaaagagaaaataaattttcacttatttttaggtctaatgtcttcagggtccagtaaaagtacagcgtcataaaagacctccttctgctccctttgctgacacctaccttagcctcgtaagccagaagacttgaaaaggttctggtccacatctcaggtaacttctgagaaatcaagaaattcttcattgtaacagcaaggtttaactctcttgaattctgttctttctggattttggcccaatatttaaaaattttcttctcagttcagcaaaatgaaagaagcttaaagtaaacagaataaagtaaaaaaaaaataaaaacaattaaattaaactggatacaggaaaacaatggagaaaattaatgaaagcaaaagctagttctcaaaaaaagattaataacattaataaacctctacaaagactgacaaagatgggaaaacagaggacctacattgctaaaatcagcaataaaataagaaatataaccacagattctacaaccagtgaaagcataagaagaaaagtctgtaaactttatgctagtaaatttgacaatttagaaggaatggccatttcc

SEQ ID NO: 387166 - DNA, 625 bp, Homo sapiens
acggtcggaggagtgtgagctgagtaactgggccggcggttcacagcggtcgtgactggggccctattaccttttggatcaaatgaaaaattctcattctttgtaatttgacacctgctggctgcttacatttacattttacttctatccaacaaacctctactctgcccctgtcatctgcctaatactctcatggacacagccatgcagatattccttctttcctttattcattcattatttctgcaaatactaactgcttgtcagatactgtgctagatgctctgggggaaacaaaagtgaatcactcactgccttgagcaactcactatccattggaaggggattaaacaaagtttttaaggaacagtgttttgtaacagaatgcacaaagtgctgagggaggagagaggagctgaaggcctcacagaggaagtgaatcctgccagaagttggttaggtgttcacccggggggaagagggagtgggggccattacaggcagagcagtgtgtcccagttcatggaggcagagcagaatgtggctcaatcagagtgctgacggcaggaatacaggatgggaactagtgggcaaaaataacattgggaaacagagccagatacca

SEQ ID NO: 387167 - DNA, 611 bp, Homo sapiens
actgccaatgtgtagatgtggaaactgaagcccagagagggtatggaacttgtccaaggtcacacagctggttaatggcttggtaaggaatgggttcaggagcccagagagggtctggaacttgtccaaggtcacacagctggttagtggcttgataagctcaagctctcctgacggcccttgtccctacaagcagcttcctctccaaggagtcccctaagcctgcttatatggggcttgagacctgtgctgtgataaatctgacttgcttaggggtgagctaagggattcctcctcttagaccccccatccatagctaccaggtacttgacaggatggaaatgtttcaccctccaaaagtaccctgtaaaggcccaacctcgaaccagaaagaatgtgtgtacaggaataaaggattgtggttcttaacctgtttcagttctcaaccccggaagaaactcatgaatgccttttcttagcaaaatgcatataaagaaaacgtgggccgggcgctgtggctcgcgcctgtaatcccagcactttgggaggccgaggggggcggatgacgagtcaagagatcgagaccatcctggccaacatggtgaaacccc

SEQ ID NO: 387168 - DNA, 385 bp, Homo sapiens
ctcacgcctataatcccaacactttggaaggcctaggtgggaggatcacttaagcctgggaggtgaaggttgcagtgagctgagattgtgccattgcactccagcctgggtgtcagagcaagatttggaaagatagcgaaatattcagcactgataaatgatacagtccacagtctcaagaagctcaaacaatagcagtcaggatttttaaaaagcccacgctgagattacagtgaacttaaaaagaaaagaaaatcttaaaagcaaccagagaataaaaggagggacaattggaccaacagctgactcctcaacaagcaataacataaaccagagacaaagaaatggggctggcgtgatggctcacacctacaatcccagcact

SEQ ID NO: 387169 - DNA, 918 bp, Homo sapiens
ggaaactgccccatggacagttttatgacgtagtctgaagcacaggaaatgggcggcacgggagcatcgggggacttttagaagttgtattgctttcttaagaaaatgctgctggcttctggaactgcagtttaattaaattcagttggctggataccttcaaaagaaataaaagaaaataaaaaaaaacaataaaaaaaaaagaagaaaaaagaaaaaaaatataaaaaataatagagtatagaaaaaaaggggcgggggggggagtagaaatctgttaagggtggaatagcgttgcgttcctcaggtttttcgtaaaagtggggagaacgtcactcgggggatcatatgtagctcgagtgaggtgcagagagacagtctgtggaagtgtctcccaagaaccgcgcgggaccaaataacccggataccgttggcaagatccttagatataggctaaacccccccatctggtgagagggcgtctgtgtacttgggcgcagagacatcaactgctttcgacgaattatgtactttacagtgcgcataagagcggaagatatgacaaagagtaaccatgggccaaggggagatcattaccacgtgattcagaacccaagaagtcccagagaagatctctagcaggtggcataggtgagagctaaccctggagaccatcaccagaatgtttccacggtggcaaagatctcttagataccgagcgtggatgacctgtacaaaacgaaggcttgaggagaacccccttcaggcgggaacagaccccctggggtgttggcctgggggaacaattctggatgaagaaaggatctcttggccatttggaatggaaagactggctgatagcagttcacgcccgcctaagattttgtgtgtgaattaggccagtaagtgaatctctgg

SEQ ID NO: 387170 - DNA, 1035 bp, Homo sapiens
ctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgt

SEQ ID NO: 387171 - DNA, 476 bp, Homo sapiens
tgtactggaccccatgggtgcccagcagagtcagcgttgtaacttgggccacctgtggacctcagctaatggtggtgtttccagtgtggaggcggtggttggggaggatgtcctggaaaagcccagctaggggctagtgtggggacctgtcctagagggactgcctctctgactctaagcagagttctctccgtcccttccagcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactgtgagtaactcagggccctccttgagtggggcccatcacgctcctgagcagtttccatccgtgtgagttgcactctctggccttaatact

SEQ ID NO: 387172 - DNA, 325 bp, Homo sapiens
atgtctgtgaaattttcactgcatttgcatttaagaacatttgaggacaatggaagtgtgaatggatttggagagggaatgccacctgctctagaagaagccgccttgggatctgcatttctgtacctcgaattgcccttcagagcagcttcttccttgcccggctcatatcccccagaatgaactaactacactgccatccaaaaacagctgttttttagccagtaacaacccaggcatgtactctgtgtaccagagcgttttcaataagccacagatccttaggctgagaaagaagccactggaggttcagagccaggcacgg

SEQ ID NO: 387173 - DNA, 494 bp, Homo sapiens
gaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtca

SEQ ID NO: 387174 - DNA, 595 bp, Homo sapiens
  misc_feature (587)..(595): n is a, c, g, or t
atgacaccaaaaagggtaaaaagaaaaaggagggaattgtaggaaataacctatatgtgattacctattttcaattctaagtggcttggtataggtttaggcaggctacctggaaataaagaaataaagaagcagaatgtactgagccaccccctccaccttccttctttccctttcacccagtggccaggcatctatcggtgggggccccctcatctaccccttccccactccacagagaaatttagtttaagctagcttgcaacatagataattgtaccctttcttatcagctaagtgcagccactagagccgtaagtcaaatgtttgaaaaatcctgagagtcataatgcattgtatgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttcannnnnnnnn

SEQ ID NO: 387175 - DNA, 538 bp, Homo sapiens
acatgagggctccctgtagaccagacacacaccaccaacccagaatgggtggggtgttgaggatcagaactgcagagcatggccctctcctggctagaacagggcccttcatgcctggtgcatgtcagcacacacaatcggcctgcagaagaaaaaatccgtctatcaatcagctaagcagcaacacctccttcctgttctaatcagtcgtctaggggctgccacaagcaagagagcaaagccagcaaagaaagccaccccaagccctgtgtttcagtgtcccctcctctcacagtccccctctgccctggcatgggacccacttcattagcgcatggtcccgctgagcctatttcagctgggcttcatacccttccactcccatctcctgattccactggagccaggctcctctgcactcagtcagtaaacattgagtgacttaagtattcattagctagaacacttgaggccctcaagggactcaggaatgagtagcagccttctgaaggtcatgtcccatcatctaggcagaaag

SEQ ID NO: 387176 - DNA, 114 bp, Homo sapiens
tttcccccagtctccagttttaccctgacttagagtccacaaacttcatcagaccctctgtgctcatggacttgggcctttctagagggaagcctaaggctcggctccagatga

SEQ ID NO: 387177 - DNA, 467 bp, Homo sapiens
aagtggaaggcgcctcttcgttctctcttccgcgcttcgctgagggactcactcgcgcatcacccgcggctgccggtcgagtgtcccaggcgctccggggccgcggtgaccctcgcggtgcggaccgaggaggaagcgccgtggggggcggggcggcgccgcacgatccggccttcagcttcacggacgtgggctgagaacccgcccgcgccgcgctgagcagggccgagggagccggccagggccccagaggagtccggaacggattcccgtcgctaccgaggtctgcgcgtgtaaggagaggacgtcggagatttgcctcgaggggtggggtatagatgactggagaggtcaggcgcgggttggtcatcgctgaggctgggtgatgggtggccggattcgttatactgttttctccacttttctgtatgtttgatatttttcataataaagtttgtaaaagtaaa

SEQ ID NO: 387178 - DNA, 887 bp, Homo sapiens
gggtgttatttaataaggaatggtcagctctcttcccgaagcagtggccggttccacttgtgctggaaatgttggggagttccagttgccccctgttcataccagccccaatggcgtcagtctttctgtttttagctgctctggtggatgtgtggcacctcgtggttttaattctcatttctctcatgactgctggggttgagtgcttttcatgagcttgtctttcctgaagtgtgtgttcatgtcttctgctatttttaatgggctgtagtttttgttagtgagttgcagaaggtgacattctggacaccagttcttttcaggtgtgtggattacaaataccctcccagtagtggcttggctggtcaccttccgaagtgtttgttgatgagaagctttgagtttttgataaaatctaatttattacgtttttcttttgtgattattgcggtctgtgatacaggaagaccttgtttagcttcagtaacaaagattttcttttatttttctctaaaaatgatatggtttcacagttagtcctgtgatctgcccgggactaattctcaagagcagcattaggtgagtgttgaggctgtttcccccatgtagatactcacttgtctcagcagcatctgttggaaaggctttttagcccgagcacagtggctcacgcctgtaatcccagcactttgggaggctgagtcgggcggatcactcgaggtcaggagttcgagatcagcctggccaacatggtgaaaccccatgtctactgaaaaatacaaaaattagccaggcgtggtggggcgtgcctgtaatcccagctactcgggaggctgagataggagaatcacttgaacccgggaggcggaggttgcagtgagccaaga

SEQ ID NO: 387179 - DNA, 734 bp, Homo sapiens
aaaaaataaggctgggcatggtggctaatgcctgtaatccgaagcggatggatggcttgagcccaggatttgagaccaacttgggcaacatagcgaaacccccttctctataaaaaaaatacaattagccaggtgtggtggagggcaccggtagtctcagctgctcaggaggctgaggtgggatgatcactggagctcagggggtggaggctacagtgagctgtgattgcgcctgcactccactctgggtgagacagcaagacactgtttcaaatacacaaataaataaattgaaaaaacatatgatgttctgcacacatactgaaaaaaaacttgggtaaaacaagatccattcttaaaacatctctttagaaaacagagatgtatgaatacttatttgatgtaaatgtatttatgtttatgtatgttaacatggtacacctaacattagctatgtatgtgtatgtatacatatgtataaatatgtgcatatatatgtgtgtgtgtctttgcataaaattccaaaagctagccttttccttggtggagaaatgctaaaggcagtctcactaaggtcaagaactagacaacaatgctcaatatcttgacccctattgttttggaattattagctagtacaagtggacaatagaaaacagacatattaaaattgtaagaataaaagaaaagactattttctgttttcagatgatctgacagtatatctggaaaat

SEQ ID NO: 387180 - DNA, 369 bp, Homo sapiens
gggcaccaggatttggttgaagtcggcctggctctaaaacttctacacgtttccataccacacagctcgcactgcttccaggccacaattttatttttttttaaagaaaataaaatcctttttcctgccatgactggagtctcttaagcctcagaaaatatgatcatagcttgatttctttgcctttttccagaatggagtcccatggcacgccctaccttaatgtaaatttcatgcaaatagtatatggtatttctacttaacaaactttgaccatgtattcccaaagtgccagacagttttctggatacttccagatgtgtcattcgatggaagaagaagttgtgctttttattttatagagagcaa

SEQ ID NO: 387181 - DNA, 709 bp, Homo sapiens
cagatagcaataataatgccttccatttattgaccatcttgtggcagaaatcctttgagcacttccctacttccctagagttctttcatgaaacacatcagcagctctgggtattgccatttgcagaattgaggagggtatgggaagctgaagttcagggacattactttgctgtgaatttgccaccagaaatggtggtgtccaggactgtatcaaagccatatggccatgaggattttgctttgagtaaagttgggataacttttagagttctgtaagatgggaggatgaattggaccttcctcctagggtgaggcttagatgagttcccacatctcaggacacgcaacaggctgggcacagccactgctgggtaaaggctgccactgatattatttgtattattttgtttttattatagttgtcatcttgttgcttgtctgtgcttctgaaattacagttaagtgagcatccaaaggctcttctcaatcccaaagcccacccctccgcttctgcccttcaagtggtatcagtggagcactgcgtggttaggactttcggcgtaagagacaattaatcaaagttaatggacacttctttgttacacaacacgactaatgtcaatggcaaacaaatcactgaaaaacaatgaccaataaacccaactgaaaggtttttccattgaaaataaaatcaaccatgcctaatc

SEQ ID NO: 387182 - DNA, 660 bp, Homo sapiens
tgggattacaggcacagtcggccaatatttttatataccagattatgtcactagtaaatagagataatttcactgtctccttttcaatctggaggcattttcttccttcctttttcccttcccttctctcccctcccctccccttccctcctgtttttctttctacttactttcttacttttgcctctttgtcttggttagaatttccagtatgatgttaaataacaatggaaagagcagttatccttgtcttgttcctcattttagaggcttaaccctggagtttttgtctatgccccttgtgaagtttaaaaagtttttcccaatcatagtttgttgatggttcttataatgacagagcatttgatttgattaagtggttttttctgcttttattgcaatgatgttgtgatttttgctttttaactattgatatggtgggttacattgattgatttcagatattaagccaactttgcatttctgggaataatcccactggttgatgatggataatcttttttatatgttactagactcatttttccagtattttggcgaggatttttgcatctatgttggtctatagttttcttttactgtgtacctttgcttctgatattgaggcaataatggtctcaaaggattagttgagaattg

SEQ ID NO: 387183 - DNA, 172 bp, Homo sapiens
ataatgtcctaaaaatcaaacagctaccaaacattgaattgaagttctgacttatataaatcatttgcataaaaactgatcattaaaaacagtatctaatgaacattttggccccaatattaattaaaactgaaatgatagcattacaagctaaagattaatttcaatgaca

SEQ ID NO: 387184 - DNA, 520 bp, Homo sapiens
tgtagtcatgtttgtgacatgcctaaatattcactattactatattactacaaagtccatactttatagttgagtgatgccttctatacagtgatattgtccccttagattaatttatttcatttaagggacaaagactctcacatatgtcatttgtctcttgacaaaccctgtggtggtaatgaaaagatcattttactgagcaggttgctgatgcctagaaggctatggctttctcagagtctcatggctattaagtgatgaagctgaaaccaaactgtcatagtcctacttcatctctagtgtgtttctacagagtcttggttcctctctctggcttcttttctattccttcttctgaatcttgtaagaatttgcattaccctgcttattgccagaatgtctttgtgttaatgctttatctaactgtctgctgaattctcacctcccctctgagatcagtgccagacctcatcaatggtatcatgattctttccctaaatttgctagcatttggtat

SEQ ID NO: 387185 - DNA, 321 bp, Homo sapiens
cccacagggaggcggtctcaggagggggtcagaaaaggcactggggagggaaggcacaagagggggggcacgaggagccgccttcccaagggtggtggttctgcggggcacctggaaggggatggcagacaagctgcccaccacggtgggaaataaggacacaggggcggagcgcgtcttaacaagaggatttaagatttggcggaggggagccacggggaaagctgaaaccggggtttacattcctgggaaatgccagagcctggcctcccctgcgcctcccctgcgcttcctctgcagcctgtgagctcccgcccacct

SEQ ID NO: 387186 - DNA, 305 bp, Homo sapiens
gccaccctccctagagtccagcgctaatacaaccacctctggcctcagagtccccgggactcactcactcacttcactgatcagccgtggaatcctgaattcaaaccctacttcctaaacatcttttgaggcctacattcctcttgtaataaaaataaggaaaatgcaattttctgggattttgtaggaaaaaaagagaacataagtgaagatatctagcagagcatgtgcctctcacagaccttaggagttactgggaaatacaagtgaacaggccgctgtggagtgcgggaattcagaaaagc

SEQ ID NO: 387187 - DNA, 276 bp, Homo sapiens
tatttttgagtaggttttgtttcaaaggaacttatattttgggtttcctgaaaaattttctaatacttttctaatcttatttgctttatagctggggacttaagcataaaaagattatttttaaaacatacactttgaatgttagacataaattgtgttaggttttggtcttggaaacaagttctgcagtcatttgtagtaccacggtatggcatagagtaaggtcaacagccctgagtttctgtagccttgtatgccttcatggatttaccagtt

SEQ ID NO: 387188 - DNA, 381 bp, Homo sapiens
ggaaggatctgaaaataacttcttaaataagataaataaaaagaacaacatctgttcaaataattttactttaagtaaaatactttctataccagtattttctacttccaagaagtaatatttttcaaatatgtggaatgaaatataatgcaaagtttttaaacaataagtcagtaatgcctaacctgaatataggcatttaattttgtttcttttacaaatttgttatatgacttttgataggtcacttaattctctggacttcagcgttctacataactgcacaattacttatctgagaaattacttattaagtactccagaattacatgtctttgttttctgttttattgggtttaaatcagttaattaggattttaa

SEQ ID NO: 387189 - DNA, 218 bp, Homo sapiens
ttcagtgctcaggatatcaatggcatctttatctccttaagtggtctaggtcaggacatcaccacagagaaaaacaatagcttgaatcccaaattatttaacagtcaaagacttcttcataaaaataattgctccaggaaagggagatttgtgtgacattaggcagccaaagtgtcttcctgccagaccctttgctcttggtgaacatgctagatcag

SEQ ID NO: 387190 - DNA, 168 bp, Homo sapiens
aacttatgtacttattgtacatattatatgcagtatacaataagtatacttatgttgtcttattaccataaacagagcagtggtcatgatatataaatactgaggaaatcaaatgttttctttttttgtgatctaatatgaaaatcaatgcaacatttctggataatt

SEQ ID NO: 387191 - DNA, 196 bp, Homo sapiens
tagaaagctctgttgaggtcagaggattgaagggccactttggggacccttgctgaagatgatgggctctgctctggggatgcccagcctaggtggtcacagaacccagcttgctataaatacttgccgaatggtggggacttcctgatgtgccttcatcctaacatgctctgcagggcccatgacttagccacag

SEQ ID NO: 387192 - DNA, 2862 bp, Homo sapiens
gcatcatacgatagacgcccgaacacggtcagcgcaggcttagagatgtggaagtatctggccggatctcatctatagctgaggtcgtgtcaatcacaattaaggcagcgtgagtctgtattaataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaa

SEQ ID NO: 387193 - DNA, 2855 bp, Homo sapiens
tacatggctctttttgaatctgttcttggttccattccttggctacgattttacctcttccttgtataaatttgaatttaaaagagaaaacaagtaaaaaaatacacatctttacacctagcccatcatcattgtctgtttctcttacagataaagcttcatatacctaagtctgcatttttcttctttttgcagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaa

SEQ ID NO: 387194 - DNA, 2520 bp, Homo sapiens
tacatggctctttttgaatctgttcttggttccattccttggctacgattttacctcttccttgtataaatttgaatttaaaagagaaaacaagtaaaaaaatacacatctttacacctagcccatcatcattgtctgtttctcttacagataaagcttcatatacctaagtctgcatttttcttctttttgcagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagcccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaa

SEQ ID NO: 387195 - DNA, 2891 bp, Homo sapiens
agcgggaacatggctgccgccggccgccaaccggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaa

SEQ ID NO: 387196 - DNA, 2797 bp, Homo sapiens
agcgggaacatggctgccgccggccgccaaccagatggctggagccgtgtggatgggcataaatggctaatgtccagcaaccatcgatgtcaagtatccacacacctggcctgaatggatccctctgcctttcagagtttgggatatgagattgaaaatgacgactcggaattttcctgagagagaagtaccctgtgatgtagaagtggaaagattcacaagggaagttccctgcttgtccagtttaggtgatggttgggactgtgagaaccaggagggacacttgaggcaatcagctttaactctggagaaaccagggactcaggaagcaatttgtgaatatcctggttttggggagcatttgattgcaagctcagaccttccaccgtctcagagagttctggcaacaaatggtttccatgcacctgactcaaatgttagtggtctggattgtgaccccgccttacccagctatcctaaaagttatgcagataagagaactggtgacagtgatgcctgtggaaaaggcttcaaccattccatggaagttattcatggaagaaatccagtgagagagaagccctacaaataccctgaaagtgttaagtcttttaatcattttacctctcttggtcatcagaaaataatgaaaagaggcaagaaatcgtatgaaggtaagaattttgagaacatctttactctgagctcatcgcttaatgaaaaccagagaaatctccctggagagaaacaatatagatgtactgaatgtggcaaatgcttcaaacggaactcttctcttgttttgcatcaccgaactcacaccggagagaagccttatacttgtaatgagtgtggaaagtccttctccaagaactacaacctgattgtgcatcaaagaatccacacaggagagaagccctatgaatgcagtaaatgtgggaaagctttcagtgatggctcagctctgacacagcaccagagaattcacacaggcgagaaaccttatgaatgcctagagtgtggaaaaaccttcaaccgaaattcatccttaattttgcaccaaagaactcatacaggggaaaaaccatatagatgtaacgaatgtgggaaacccttcactgacatctcccaccttacagtgcatctcagaatccacaccggtgagaagccctatgagtgtagcaaatgtggaaaggctttccgggacggctcgtacctcacccagcatgagaggactcacactggagaaaagccctttgagtgtgcagagtgcgggaaatccttcaacagaaactctcacctcattgtgcatcaaaagatccattctggggagaaaccctatgaatgtaaagaatgtggcaagactttcatcgagagtgcgtacctcatcaggcatcagaggattcatactggcgagaagccctatggctgcaaccagtgtcagaaacttttcaggaatatcgctggcctcattaggcaccagaggactcatactggtgagaagccctatgagtgtaatcagtgtggcaaagccttcagggacagctcctgtctgaccaagcaccagagaattcacactaaggagaccccatatcagtgtccagaatgtgggaagtccttcaagcagaactctcacctggcagtacatcagagactccatagcagggagggtcccagccggtgtcctcagtgtggaaaaatgttccaaaagagctcatcccttgttcgacatcaaagagcacacctgggagagcaacccatggaaacataatggttgggggccacatgagtcttccagttcactctcactcctgtgtttaggaggcgtgtcttagatctgactcctctctggtcagtagaaaagaatcctttaagctatccagtgaattgatgaatgtgagacattgctgagccacactgttaagtctgctcattggggaactccagagacaacttaggatgagggcagaaaagtctttggggatgattcagtctgtaccagacatgacaacacacacactggaatgaaatgtgcaaacatgggggtgacaccacagagagaacctgtgaatgcattcagaacatgattggaatgaagagccctgtagtagggagtttccaccttgtacgtaagcaaacactgaatcaacttttttttttttttcggacagagtctcactgtgcagtggcatgatctccactcacagcaacctctgcctcccaggttcaagcagttctcctgcctcagcctggccagcatggtgaaaccccatctctaccaaaaatacaggaaattatctgggcatagtagtgtgtgcctgtaatcccagctacttgggaagctgaggcaggagaattgcttgaacctgggaggtggaggttgcagtgagctaagatcgcaccactgcactccagcctgggtgacagagcgagactccatttcaaaaaaaaagactgaaacaagcttgtgctaagatggaaagggctgcttctaacagatgtggtttgttgctttagttgttgaagcaaaaatactgagttgttatgtttatgttatcaccccaccactacctccatggttgttcatttaggatgcttctaattcagccactgtgaaccattataaaggttttattgccatgttgaaaatgtttataatatggcaaaaaggggcatcaaatagaagatttactattattccagccatgtaaaaatatgtgcacatatggatgtatgttgaaagtggatgatggagaaataaaatgtggttttctttggggactggaaaaaaaaaaaa

SEQ ID NO: 387197 - DNA, 754 bp, Homo sapiens
agtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagataggccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccattt

SEQ ID NO: 387198 - DNA, 4165 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387199 - DNA, 4102 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaatttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387200 - DNA, 3058 bp, Homo sapiens
ggaatagtacgaggcggtacgcggtttgttatttcagtcacgagggatcagggtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387201 - DNA, 4435 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaaaaaaaaaacaaaaacaacaaaacacaaaaaccaaccaaacaaacacacacacaaaaaaaaacaaaaaaaaaaaaaaacacaaaaaaacaaaaacaagagaaaaacgacaaacaaaaaaaacaaacaaaacagcgagacgagtggcgggcgcgtgcgctagcgagttcttcgccgtcgatggagacgccgtacaccaccccccgccaccctgccctgctactgcggtgccgacagcggcgcgcgccaagatcactcgcagacctgacctcg

SEQ ID NO: 387202 - DNA, 4789 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctgcccaaacccctcctgctcctaaatgtctgtctctggtgttaaccagaggctgctcttcccaggctgctggatggctaccttgcaggctgtcacccttaacaagaaataaagtgtcctttgca

SEQ ID NO: 387203 - DNA, 3305 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaatagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387204 - DNA, 3586 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccgggatacagaccaaaagctgccatggagtggcgagggtggaagcagcggcacaggccgagggccatctcgccggggaagggtgggtacagcacaaccctgtggccacgttttcctcacacaggaaattcccacagaacacccaggagggtgacgatgcctccccgggatacag

SEQ ID NO: 387205 - DNA, 1009 bp, Homo sapiens
tcttggagggcgaggacttcagggaggagttcttccgaaagaccgtgttgctcctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387206 - DNA, 1171 bp, Homo sapiens
gatacttcatctgtgatacagtagggtgattacagtctccaccaaatgctaaactctggggtcttacgcctttataactccatgggccccagcaaaggttcaggctcaaaacaggttgctgcttgcggggctgtctccacggccagtgacagcatacacagtgatggtataatcaactccaggtttaaggccgctgatggtagctgtagacttgctcccaggcacagatcacccttcgtgcacacacacacagatcacccttcgtgccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387207 - DNA, 3124 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctctgggctgtccacctcctctgtgctgtccacctcctctgtgctgtccagtgctgtccacctcctctgtgctg

SEQ ID NO: 387208 - DNA, 1558 bp, Homo sapiens
acttattacggtctacatgagcggccgtacttagctcgcaccatcgctctactactatgaacccctcctccgcataccctaccccctggtcaacctcaacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggaaaaaaaaaaa

SEQ ID NO: 387209 - DNA, 2432 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttaataggtaggctgcctccgacgaagttgggctacgagctcgaatt

SEQ ID NO: 387210 - DNA, 2330 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgccatcgtgcgcttcgggtaccgagc

SEQ ID NO: 387211 - DNA, 2256 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggtatttgttcatttcattaggttactttttctgacaatttatgatattttattcactcatttaaaaaccatttcattaaaataattggaagcatattctctcttgtgctatgggcctaatatattctgttatctttgacagattgtgcagaaccaaaagttactgaaattcagcacattcaagtaattagatataattcttatattctcaaaaaaattcttacttatatggcttatcttagcacggcagtttctagataaaaggtttcccttgccaagctgcagtggctcatgcctataacgccaacattttgggaagccaaggcaggaggattgcttgagtccgggagtttgagaccagcctgggtaacatagtgagaccctgtctctacaagaaattaaaaatattagccaggcatgatggcacacacctgtagtcccagctacttgggagctgaggtaggagtatggcttgaaccaaggaggttgaggctgcagtgagccttgattgcaccactgcactcctggctgggcaacagagtgagaccctgtctcaaaaaagaaaaaaataaaaaaaataaagtgattttatagggaatattttgttagtgtagatatggtatgccagatcctgaaaccttgtaggaaattatacattctgaacatgtagttcagttccattaatcctgaaaatacttataaaatcctatttcctgaagaattacagtatattggtatcagtgaatgctaataaatatgtaggtgggcaatgatagtcataaactaaaaaaaaa

SEQ ID NO: 387212 - DNA, 4283 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagagtcttgctatgtcacccaggctggagtgcggtggcaccatctcggctcactccaagctctgcctcccgggttcacaccattctcctacctcagcctcctgagtagctggaactgcagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387213 - DNA, 3485 bp, Homo sapiens
ggggctatattctgaactcttcctctactgttagctcagtattatttcagtaattggctactttaaacaaattatggttgcttctcttttatagcatattataaaatgttactgatatatagacaaaaaatttggaaatggccacctattaataactagattctttttaggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387214 - DNA, 5175 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggaaaaaaaaaaa

SEQ ID NO: 387215 - DNA, 5011 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggaaaaaaaaaaa

SEQ ID NO: 387216 - DNA, 3466 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctgtgtgtgtctgtatatttgtgtgtgtctgtgtatgtatgtgtgtgttttgtgtgtgtatgtgtatctctttgtgtctgtatatttgtgtgtgtctgatgggagtata

SEQ ID NO: 387217 - DNA, 910 bp, Homo sapiens
ggacagatagaatcgagccggtacccaggttagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387218 - DNA, 1893 bp, Homo sapiens
  misc_feature (57)..(57): n is a, c, g, or t
aaactctgcaaaacactcatccgtagtgaccataaacatgacataccaaagcagagnctcagaaagatggagcaacagactgaggacattttcaacatggtacttggggatacctttgggaaagatgccttccccagcagaggccagcactgtggagagataggaccagagccactactggcacagttgtcaagatcttttgctttctgaactctggggaccgctgccttttagcctgaggggaatgtctccaaattaccccctattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggaaaaaaaaaaa

SEQ ID NO: 387219 - DNA, 2054 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccattgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagataggccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccattt

SEQ ID NO: 387220 - DNA, 1324 bp, Homo sapiens
  misc_feature (103)..(103): n is a, c, g, or t
agcgggggtgggcagggcgctggccgcgctgctgctggccgcgtccgtgctgagcgccgcgctgctggcccccggcggctcttcggggcgcgatgcccaggcngcggccgccacgagacttagacaaaaaaagacatgcagagctgaagatggatcaggctttgctactcatccataatgaacttctctggaccaacttgaccgtctactggaaatctgaatgctgttatcactgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggttggaatacagatttggagaatttggaaactattctctcttggtaaagaacatccataatggagttagtgaaattgcctgtgacctggctgtgaacgaggatccagttgatagtaaccttcctgtgagcattgcattccttattggtcttgctgtcatcattgtgatatcctttctgaggctcttgttgagtttggatgactttaacaattggatttctaaagccataagttctcgagaaactgatcgcctcatcaattctgagctgggatctcccagcaggacagaccctctcgatggtgatgttcagccagcaacgtggcgtctatctgccctgccgccccgcctccgcagcgtggacaccttcagggggattgctcttatactcatggtctttgtcaattatggaggaggaaaatattggtacttcaaacatgcaagttggaatgggctgacagtggctgacctcgtgttcccgtggtgagttgccggtctgccctcttctcttccacgggttgactccaatctcctgtttttcagatgatgctggagcctctcttctgagacgggcatgtgttatgtggttaggaagtccttccaaaagtcctgttactggatagttctcatacttgacccagtgcctacacgtgtgtataaaagagtgatttggggccgggcgcggtggctcacgcctgtaatcctagcactttgggaggctgaggcaggcgaattacctgaggtcaggagttcaagaccagcctggccaacatggtgaaactctgtctctactaaaaatacaaaaaattagctgggtgcagtggcacgtgcctgtaatcccagctactcgggaggctgaggaaggagaatcacttgaacccaggaggcgggggttgcggtgagcagagatcacgccactgcactccagcctgggcgacagagtgagacttcatctca

SEQ ID NO: 387221 - DNA, 2320 bp, Homo sapiens
atgggttccaaaaagagaactacccctctcctggtacatttccaggtgtttttcacagggcaagtggatttcacaatgtgagtgctgtcagcaccaaagggaatggccaacaggcatgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctccctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaa

SEQ ID NO: 387222 - DNA, 452 bp, Homo sapiens
ggcataaattccttttttttttttcattatttttcagttatctctgtcaaatactgaggagccagaggcattttgttcccgcccttccttcctagtcctgatgtgattggtttgcacatgaccatggaggtggatggagggtttgtatattacatatataaaagaaggcacaaacaacagcctaagaactggataaccttttcctacttcccagcatcacgtgctttcaaaggccacctcttattttacacttgtttcaggtaaaggatagactagagaactggccttaaacttacacccagtttcaagtcctgacttgccaacttattaactgtgtgatcttgagcaaatcacttcatctttctaaagcctccgttctttttcatctataaagtggggatgatactctcaacttcagagttgtgaacactgaataatttctataaagtttt

SEQ ID NO: 387223 - DNA, 222 bp, Homo sapiens
ggaagcctgggtcactcaacactgtgcccctgctgtggctgggagccatgggtcctgcatggaactctcagagcaggcaggatccgccccaacctcagcccacggggaaagcagccactgcctgcagagagggtggggctgggacaggaggctcggggtgagtggggtgtagggacaatcaggaatccttccagggggtgccagggccgtctccacctcctg

SEQ ID NO: 387224 - DNA, 448 bp, Homo sapiens
gacttcagagaagagtctgcctggagatggccagactccaggggaagatcaccttcctgccccatccccctttcagctccccttcccactgcaagctgctttcatcagcaataaaatcctctgcattcaccaccattcgatttgttcgtgcaacctcattcctcctggacatcagacaaggacttgggtgtgggtgcaaaaggctgtcacactgatcttctactgagctgttaacacttaagccatctgcagacagcaaagataaaacagcacactgtaacgtatgcccttttaggcttcaaggttcgtgggtacataccccctagatgttaccaccagggtgcatggagttttggtcctgtcagtgtccaaaagtgcttgctgcagcttttgcacctgctcacctgcacgctccctctcccacagggggttgagagctgtaggccaa

SEQ ID NO: 387225 - DNA, 222 bp, Homo sapiens
tcaacaaaatttctaaaaagttaaaacaaaaatgccacacatcagaatctatgacatttatttaaaacagtgattaaaggaaaattcatagccttaaaaatttatacaaatttgtctgaacccatagaatgcacaacagcaagagtgagtgaacaacagtgtaaactacggattttgggtgattatgatgagtcaatgaaaaatacaaaagtaatgagataa

SEQ ID NO: 387226 - DNA, 382 bp, Homo sapiens
aactaaagagagtgaattttattttagaggttatctttattttaggaattttaaaaatatattatagaaaaggctggaaatttatgcctatgggagacaattttatttctcttgtttcaataatagcaattaaaaaacaagacattaactgtcagtaatctattatggtgagggttatatgaatatatacatgtgttaaaatgtatggaactatacaccaaaaaagtcaagtttactatatgataccgtagaaaataaaatttttaaaaatcaatgcattgatataatgtacaagagaaacatatatattactgtaaaaatgctgtattagtttcctatggctgctgtaacaaagtatcacaaactggattggcttaaaacc

SEQ ID NO: 387227 - DNA, 1049 bp, Homo sapiens
acggggttatgtaggagcaatgcagagccacttttgaaaaacagtagccaaggttctactggctgccttcttaggacattattaaatatcataaacacaagtggaatttaacacccagccagtttgtgttcaaccagacagcgtcattatgaacaaagattatataacgatagctgatattaagtaagttttaaaagttgacatcccaagagtgaagcctacttattcagtacagatttgttgaatgaaattcgtagttttattttacggcataatgaaacagagttccagacatgtacctgccaaatttggttctggttgtcttatcgtatgcaggctggatacctgctactgtgcttctacaggatgttaacagtgtcccctgagtaaaacagttccacggtcagtacatttgggaaccactgagttaaatgggttttatcactgcagaacagacacaagaacaatgtgtgctgtaaatcactgtttgcagggaaggtggcagcaaatggcacagaaacccacctgaccacagactgctttcttctgggcgttcacgcactgtgctccacaggatactcttgagaaacattgagctatggttggtctgttgtttgaaattcaaataataaagaatccattttaaggacaggaattggtttactgaccttgatgttgggatgactcttcatttcagggtgaaaatatcacagcatcagcacaggccaggaccacagagataacaaggtggtagttgtgtaacaggttgtgtctgaaccacaggagcttcaaaacatacacggctggacaccctgccaggatgctctaatggggctgggcatgtgtccatgaaaaagactccccagttgtttctaaaatgtggcctttgttctagaaatgcaatgaccagcatttgggagtcagtcaaaagatccacttcctaaaagcctacctgctcatttctttcattcaatacatattaaccaagtgcctactttgtttgagtccatgcctggcaatgacattattccattaaaagtcaaacaagg

SEQ ID NO: 387228 - DNA, 538 bp, Homo sapiens
atgattgtgtgccatgagttacacacagactcctaaatcagtttcacctgtggtgtcctcattctgtttactttgagcattttgcattctatatctgcttagttatatggatttattcgtcccatataatatgtgtagccacatggacacatgttctaaaaggttttaaattctgcaagatagtgacgatgatgtaaacacaagaaaagggcaaatggatacattttcctactctgtgctcatcaaacatattacaggataaaattattggctatctaataaaaacacagactaataagacctgataagttggacaaaatgtttaaaaattaacatgaagatgataggaagtatgaatctatattcactgtcattaatgtcaaacctttaccttatggtatattgtactttgagaaattatggccaggcatggtggctcacacctataatcctagcactttgggaggctgagacaggaggatctcttgagcccaggagttcgagaccagcctgggcaacacagggagacactgtcttt

SEQ ID NO: 387229 - DNA, 857 bp, Homo sapiens
ggacattagtcactggatctagggtccaccctaagtccaggatgatcttatctcaagatccttaacttaatttcatctacaaaaccctatttccaaataagatcacattcacaggtacagggggccatggactgaatgtgtccccccagaattcctatgctgaaatcctaatccctgtgtgacagtatttggaggcggggcctttgggaggtgattacgctgtgagagtggagccgtcatgaatgggatcagcgcctttatgagaagaggctggagaccgaccatgtgaggatacggggggagggtagtgctcttgagcccagaagcaggtcctcgccagaactgaccatgctagcaccttgatcttggatttgcagcctccagacggtgagagacgactgtctgctgtttaagccacccagtcttggcatttcttataacagccctaagtgataactgatttgggtgcccctattcaacccttgttttgacttagatgacattctctacagggaaaatttcttaggactattggacaaaatataaagttcttttcttgctttttggttttgcaaaaaaaagaaagaaagatgaatgggtcaatgagaacatctgaaaagtctggagtatcactgaggaaatagagggcgattgagaatccgaaagtgaatggaaacctacaacagaagtgagatatgcttttctgttgtcacctcatcggactgtgtgtgatgacacaaatgccaatagccggcaaactgcgaggaaccgaacatgatcctgacagtctcaggagtgcccccgctgaatgatttttaagttgaatatctgactaaaataaataattgtctcatttc

SEQ ID NO: 387230 - DNA, 497 bp, Homo sapiens
ggacattagtcactggatctagggtccaccctaagtccaggatgatcttatctcaagatccttaacttaatttcatctacaaaaccctatttccaaataagatcacattcacaggtacagggggccatggactgaatgtgtccccccagaattcctatgctgaaatcctaatccctgtgtgacagtatttggaggcggggcctttgggaggtgattacgctgtgagagtggagccgtcatgaatgggatcagcgcctttatgagaagaggctggagaccgaccatgtgaggatacggggggagggtagtgctcttgagcccagaagcaggtcctcgccagaactgaccatgctagcacctcccaaatgccccgcctccaaatactgtcacacagggattaggatttcagcataggaattctggggggacacattcagtccatggccccctgtacctgtgaatgtgatcttatttggaaatagggttttgtaggtcga

SEQ ID NO: 387231 - DNA, 480 bp, Homo sapiens
cttgcagcctgcacttatgagtcaacaacttaatatgactagctttctacaatagcttttatagtaaagatacctggggacggactccacttatgactccctaaagcccatgtcgaagcccccatcgctgggtcaatagtacttgccgcagaactcttaaaactaggcggctatggtataatacgcctcacactcattctcaaccccctgacaaaacacatagcctaccccttccttgtactatccctatgaggcataattgtaacaagctccatctgcctacgacaaacagacctaaaatcgctcattgcatactcttcaatcagccacatagccctcgtagtaacagcctgggtgacagagcgggactccgtttcaaaagaaaaccaaaaaaacaaaaaaggtaaaaggggctactttatttaaacagggagaaagtaaggaaggaaggaagaatgccagacatttcaaagtatgaat

SEQ ID NO: 387232 - DNA, 286 bp, Homo sapiens
aactctggcaataaactgctgagaactgcacagcagcacttcccagctatctgccatatgagaattagaacaaaacaatgcaacccaaatgggaaggtggaagtgcacaatgaatacacaaagctataaactaagtgataatttttgtcttgattgtgtgagctaactattaagaagattataattaagagttcatttcttatagtaccaacaagcattttaatcaaccttgatagcattagctccaattaccattagtaaactataaagattctgttttaaattg

SEQ ID NO: 387233 - DNA, 920 bp, Homo sapiens
gaccagagaggcacatgtcaccaatttcagttctgccccagctggcctgaggcagctcgggacttcccagggtggaaggataggtccgggggccaggctacttggaggcagggccaggtcttgaggaccccctccccagcccagctgtctgccggggaggcagctctgggttcctggagtgggctggctacggaggtgtgtgcctccctggcggccctcatctctcccggagccctagagcaggtctttctaagacttcccactcatcagccccggcccaagattatcactacaaaagacgtccttggcccactgtcccctcaaaatgaaagctttaagaacagctgcccagaggtgtctgagaaaaactccaggatgagagtgaggggtaccaggccgtcagctctccccaggctgaaggatgaggtggaaaccacgaaagcccccaaaacaaagccatcttctccacacctccaggctgttccctaaagaaggaaagcggggaatggggtggggagggcgagtggagcccccgcctcgggcggtcagcaccggcgtcagcagggaagcaggcccctggccagggagcgcatctgaccggaccgaccgtgttcttgggagatcagttgtgaaacttgcatcaaacccccaaaccacaaaaacggccagttttcccagctctgttctcatgcttctcagaccagccgaggagtcttcagcatctccagccgagagaagccaggccagctgccagcgccgggggaggagaaaaccccaagtgcctggagacccgagccccaagtttgcctgaagcaccctgctcccttcaacgagcctgggaatgtgaggtctggagaaagggtgaggcctgggccggctccactgcacctggagccgggtgcagtggctcacgcctgtaa

SEQ ID NO: 387234 - DNA, 5528 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 387235 - DNA, 3128 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 387236 - DNA, 380 bp, Homo sapiens
gggttcccagacacagacccctctcaggtgggtgtctgggctggagggctgtgggccgtgggcagtggcctggcacccgtgccacacacaccacactaggctggggctgaggcctcacagctcctgggcacagagctgctagctgtagggcccagtgctcagcaggggtgtccctcccaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccag

SEQ ID NO: 387237 - DNA, 461 bp, Homo sapiens
gctctggcccggaacatctggatgtgaaagggcatttggtgattgcacctctttctccagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatt

SEQ ID NO: 387238 - DNA, 5185 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggcgttctccgagctgccctttcccagtcacgtgcttccggaacccgggttcccagacacagacccctctcaggtttacagccccggcctgccgcctgccccggcccagccctcaagcatcccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaattatg

SEQ ID NO: 387239 - DNA, 2844 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaaaaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagagatgctaagcccccatgtcgcagtgtggtgccggggcctcccctgaagccagcgcccagaagagacagacatctctgagctacccaggataccaaagatcaggagagatgacggtggtggcagacgggatgcggcccggcccaggggcagagcattgagatcccagtgcctgatcagcgactgactggcagggagggccgggcagcaggagaggcccacggcaaagcgagcacgggggccggc

SEQ ID NO: 387240 - DNA, 366 bp, Homo sapiens
gggtgagcctggaagagtaaaatgttaggaatgcttagcacacacacattgaaaagactggggaaggtttaagaacatcatcttcagagtcagacagacctctaggtgtggctctgacatttacaaattaagtgacccaaatcaagcctcctcccataaatctccttaatctgtgcaatgggtataatagtggtgtctactcccataggctagctgtgagggctaacaagagtaacatgtgtgtccagtggctgggcacagtgaatggaatgttcagtcaatgttgggcactgctgcacagagcaatgacatcactaccgtcatcatcatcatcatgatctctgaagcattcttaaatgccgaaag

SEQ ID NO: 387241 - DNA, 1014 bp, Homo sapiens
  misc_feature (1)..(2): n is a, c, g, or t
nngggcagtttttacattgtgatgtgtgggtggatggtcatatttagttaggttattaagaaatcatgaagtgttccctaacaagaaacttgcaaagctatttggcaggaagaaaatcattaacttctagtttatttattttttttctcatgctatacgcttaattaccaagtaaattcacttgcataccattaccttaattcaaaggagaagccagaatgtttatcattggtgggagtaaaatatacacagattctttaccatggtgaaatagaataatactgaattcccaatacagaaatactaatttcataagctaatattcctatcttttagctgacttctttctctcttcaggatatatttactatttattatttacctttgaatttttgatttgggggatttttacctattgccatcctactatcttaagtatcctgtacaatgaaatatcttagcaaggaaacacttttaaaacttcacaaatatccaatttcattcttaacatatgggggaagcagtaaaagaaaaagcacttcaccacgtagaagagaaagtgatcattttaattaagataatttcaattcattatcaacatttaatcctctgcaaacaagggaacacttactagcagtacttgaagacttgtgagttggaattgcatgttacttgaaagatctaattaagctaaattttggtgcacagcaggttgtacatgatttcatgtttatgtagcaaaatgcattgaaatgtattagtgttgaaacatacatgtaaaggtagttgtggaaattgttatattttccttgtgtgtcatttatttagagcataaaggttttttttattcagcctaactgaataaggctaaatgaatactgtaattgaaaatatattttaaatctttgtcatgagtttttttaaaaaaaactattgcaaattgtatcattcctgattacacagaactttgtgggtggttttaaataaattttatacttctattttgcaaaaata

SEQ ID NO: 387242 - DNA, 409 bp, Homo sapiens
aaaggtgatgctttctgtaaaattgtctgtttataaactaagcataaaatgtcaaaaggttcttgtgtctggtattctaaatttaaaaaaaagttcttagtttatgattcttaaaatatgggaaatgaacaagtactcactgtcgtctctagtcacctattcctatttttggctgacaacatttctggttagagctttatttggaagctttaacatattttaactgttacacattactcagctcaaactatagccaagataacttgcttgtcagtttattaacagcaaattattcaaatatgttccatcgtttgtgattaaagggcctgtggtgagaggggagagatgaagggaggaacaaacaaagatggggagggattgtcacggttaataataaaacagtatttct

SEQ ID NO: 387243 - DNA, 502 bp, Homo sapiens
gaaatgcagaactggtgaagaaataaattaacccctgttgatattctagaaaagcatgataatgcgttttgaaataattttatttatgtctctctctcatgtttaagatattgaaatactcaaaataaccagcagtcttattgcagtgtatattgtttaaattatcttaattagtcaactttagaaataattttcaaatgctgaaggaaaatttttctttgaaattttgtgaataaaatgtagtatacatagctgtgacattcgaaaggaaagtgtaactgtccacagcagttgggctttaggacagtttgatggggcatatgagagacggaagagagagagttttgaggagcagctgcttttatgcctagaagacatttagaatcaaaaatggggagaaacgggaggtaaattgttaactgtttaactgtacatttaacatttactcttccttttgaagtttctcaagttgtgaataaagatttgaaattatatcaagtat

SEQ ID NO: 387244 - DNA, 589 bp, Homo sapiens
aagtcaggtggagaaaataagagtggaagagggagttcttactggggagaactggaaaacacaggtagggtagagtcagataaagaggtctctgaaactagacttggatattaatggaggaagcaatgggaaccactgtagttttgagcagagaatcagcgtgcctaaaattttgtttggagatgactaatctgagaagattacgcaaaatgaatttgagggaagagaatcaaaatggtctgccacgaagaactgtagtgattcaagttcagatagtcatagaaaagataaaggaaatgaaggggtcaagaataacaccaacatttttgccctgagagactggaagagtgtgctataaagggaaatgaaaaagttgagtaactgttatggagataaagggcaaaataaacttggttttggatatcataaaggatatttatgtggaaggattctcaacatattatttttaaagacaaggtctcactatgttgcccaggctggacttggactcatgggctcaagcaatcctcccacctcagcctcctgaatagatgggtctccaggaatgcaaccaccatgcccagctttc

SEQ ID NO: 387245 - DNA, 570 bp, Homo sapiens
accatgttgcccaggctggtcttgagctcctgggctcaagcgatctgcccaccttggcctcccaaaatgctggagttacaggcgtgagccactgcacctggctattaaccccaaatttattctgtgtctttctctctttaccttcagactttgcgatgtgctgctctttaatgtgaaatgcccaactcttgtcccaaacacacatatccacttgtgaaaatctaacctatcatcaaaagtacatctcagatgataggtatttcttgaataaagtctttcatctttgcattgccatagagtttgttttacatctttcttatgacagcactcacattcaaaccgtagttatatttatgtgtatacttgtctctccaccagatgggtagtaagactcttaaaatcagagtccgaattttatcagtcctaggagtcttccattctcttcagtagataatcaaacacttttgttaaatattggaatgaataagcaagtgacttattttgtcgatttatttctacagaacattagtgatgtggtgaacaaacactttgagcacatccaaaataaaa

SEQ ID NO: 387246 - DNA, 198 bp, Homo sapiens
ttttacagatgaaaaaactgaggctcagaaaggcagtcatatagctcaatatgctagaactggagtttaaacctagttctgtgttctttcaaagcacgttactaaactgtttagcctgcttatttttttaaacgaaaatttatgtgatcacaaattcaacccatctcatgttaactaacactgattatggaatcattt

SEQ ID NO: 387247 - DNA, 411 bp, Homo sapiens
taagagacgaggtctcactttgttggccaggttggtctcaaactcctggtcacaaacaatcctccagcctcagcctcccaaagtgctggcattacaagcatgagccaccatgcccagcttaagggggatatttttatagagcatcttgccctggttctggaattctctgtagataatacagttaacagatattcccctaagtgattaagaacctttccatttgactgatttttcagaaaagtttacctatgtaacctcagtgggtagcacaatgcctgacacatctttgaagctcaaatgtctctgaggtaaaacttggtggggaggaggtaagagtaaaccaataatctataaacctgtatataaacctgtaaaaacaatcaacaaagattaagtcttcaaaaccttgag

SEQ ID NO: 387248 - DNA, 396 bp, Homo sapiens
taagagacgaggtctcactttgttggccaggttggtctcaaaaatcctccagcctcagcctcccaaagtgctggcattacaagcatgagccaccatgcccagcttaagggggatatttttatagagcatcttgccctggttctggaattctctgtagataatacagttaacagatattcccctaagtgattaagaacctttccatttgactgatttttcagaaaagtttacctatgtaacctcagtgggtagcacaatgcctgacacatctttgaagctcaaatgtctctgaggtaaaacttggtggggaggaggtaagagtaaaccaataatctataaacctgtatataaacctgtaaaaacaatcaacaaagattaagtcttcaaaaccttgag

SEQ ID NO: 387249 - DNA, 352 bp, Homo sapiens
tagtccccagaactgtgagaagtagatttctgctgattacgctttcctgtctgcggcctgagctaagacagcagcgcttggggagaagcagaatttgaggagctcctcagtggcaggctgccctggccctgctgtcagcagaggggaatggccatccatgctggcccctcaccagccgggccttcagtgagctccccgggtaggtgaagctctcccagctctgtgtcccccgccaaagcaggcccacaagcgagcgcctatggggtggagtgagagtgaggaagaaacattacccgaggggtcactctcttcagaagacctcaatgactgtagactactgaattatttcctt

SEQ ID NO: 387250 - DNA, 252 bp, Homo sapiens
acccacaaggaggggtgaagtggggggggtgttatacagatatgcaagtcactgagctcaattgtggtagagaaaaggcaatgagggcccaaatgggtaaatggcatttggggagagaggtggattcttaaactacatcacagatgatgataggagcaggagggggagggttcagatgtgtccaagacatatctacagcagagagtatgtaatgataaataatagtgatctcttttgagattcaaacagcca

SEQ ID NO: 387251 - DNA, 111 bp, Homo sapiens
gtcagtatatcaggctctgtgcggttgatcccctcttcagcatcagccaaggaatcttaccactccttaccatctgtaggcattttacctaccaaagcaccattaagacag

SEQ ID NO: 387252 - DNA, 308 bp, Homo sapiens
tgcctgaactgtccgggtgttactcttgtttctaaccagaaaataaggtcactggcgtgttgatgcccaagcaaacaggtgttagaggtgctcctacccatcaaattcaacaatggtttccactgacgcatagaaaaacaatggtgtttgcctacttattttgcaacaggctgccatactgtcttattctaattaattttgagtttgtctactttgaaaacctaagacaacggctgtatccactcaaaacattcattttgcaacctcctatctgagagttatgccctgcctctttttctttctttttt

SEQ ID NO: 387253 - DNA, 477 bp, Homo sapiens
tcctggtgtatatgactttaaaagaagaatcagtgtttggcttttggctttggctttttattttatttgtttatttattttcagaaagcatctcatatggttaaaaagaaattcagatttttatgctgaaaaaggtacttttttggtacgtagctttaaaattttaggttgagaaaagtgtacgtaaaaatcttgaaggaaaagatggagaaatttgactacatacaatttaaaaatgaaaaaccctgttgttaacaaagaagggaactggaactgtattggcaacatagatgataacccaaaggataatattcttatggtatataaagaatttttggctgggtatggtggcccacacctgtaatcccagcactttgggagaccaaagcaggaggatctcttgaggccagtagtttgagaccagcctgggcaatatagtgagaccccatctctaccaaaacagcaacaacaatgaga

SEQ ID NO: 387254 - DNA, 455 bp, Homo sapiens
aagacctactctgtcctggagaagagttagttctttgggcttttcccttaccctcaggaaaaatctctaagatcatcaaactttctttctgtgatcgtgattcagagccaaataaccttttgattagcaactcactttcccagtgtcttaatgctgggaaacagaatattctaggggaatagagatatataacccacttgcaggaagatgttctgcttggtaaatgaaaccattgacattctgatgtatcagtcccttgcaaatttagtcagagggtcaccccccacccgaattttatcaatttggaataaacaagattgcctatgtatgatgacttaaacagccccttgttcttgtattttgacatcattttaatttgtacattgtttaaacttaaataactacttagatcccaaacaataccatttcaaggatactgtttcttccttattaaa

SEQ ID NO: 387255 - DNA, 806 bp, Homo sapiens
atggacgctcactactgtgtagtagtctctgtggaatgaaattctcctcgctcctgttaacgggcttgtttctttggtaacctgagaacagtgctgacaggaatgttctcgcgcccaccccggagcctcctgctcttggggcgtgtgctctgcacgtgtactggcatctgctcgtggagtgtgtgctcctcacatgtgcctgctgctcgtcgggcgtgtgctccacagaggcggctggcacaggctctgtcctcggaactcaagtgttcctgttgcttcactcccatttcacactctgccaacctttacatttctgtgaatctgagaggtatgaagtagtatctcactgtaggggtttaaaaaatcctttgtattttgaaaattttcaaccacagctaacttttgaaagaattttacggggaacatctgtatactcctcctagatcctgctattaagattttgctatgcttaggccgggcgcggtggctcacgcctgtaatcccagcactttgggaggccgaggcgggcggctcacgaggtcaagagatcgagaccatcctggctaacactgtgaaacccccgtctctactaaaaaatacaaaaaattagccgggcgtggtggtgggcgcctgtagtcggtggtaatttcctatgcgtcattgacccacagtgaggggacacatttttacaagtgcgggcaccgtgtgactcacaccctgatcctgccgtgcccttcccactcggccccgctgcccaccctcccctccgcccagaggtgacgctgctctgattttcccaccgtaat

SEQ ID NO: 387256 - DNA, 337 bp, Homo sapiens
atatttgtacctatgtatacactcatctgatttataactaactccatttaaaggttacaatctttgacattgtccaaacaaaacatatgaactactgtcagacatgctaaaggacatacatttactactataaatcccacaaattttgcatcccaaaccctatatttaatggaagacatggacaagtaatacagtaatttatttttctggttaatagtagcaagttggccgggcacagtggctcctgcctgtaatcccagcacttcaagagactgaggtgggaagccaggagtttgacaccagcctgggctatatggcaagactgtgtctctactta

SEQ ID NO: 387257 - DNA, 524 bp, Homo sapiens
attgtataccatcagcagggaccattataaaatctaaatattaatgagtggttgtaaaactaatgtgaacactcatatacccttcacatagattcacaaattgtggatgttttgtcacatttgttttatatgtttgcttttgccagacccattgataattagttgaatttcatctccaaatactttacctttcttttatcttctaacaagaagaatgttcttcacataattacagtgcagttatcatacatttggaaacttaacattaatatggtactgtaatcaaatacaaatctatttaggaattttctcatttatgccaaaaatgtcctttattgcttttattttttaatctagcatccagtcaaagactattcattgcattcagttgtcatgataagttttatttttaatgatcatattaatgtaggatttatatatataaaaaaaactagtccaaatgacagaagatacttaacaaatgtggttttgcctttttctttttttttttttttttttttttt

SEQ ID NO: 387258 - DNA, 271 bp, Homo sapiens
ttgtaaatcttttaaaatgagtatgggtgtaaattaaaaacgaattaaagcagaggcttataaagacactatctccccttcaatgggttatgtatttttgttgtgtgttaggaagatatctcttgatctccacacccaaaactccttccaaatgaacaaaggcctacacacaaaaattatttcaattgctaatagccagtttttatttttcaaaagtaaatgctttctttttttgaaaagtaaatataactattttaacaaagtaagattt

SEQ ID NO: 387259 - DNA, 141 bp, Homo sapiens
tgcataggtatatatgtatgtcaaaacgtacccagttgtacataaatatatgttcggtttacatatcagttataccccaacaagcctgttaaaaaatgacatgctggctgggtgcagtggctcacgcctgtaatcccagca

SEQ ID NO: 387260 - DNA, 580 bp, Homo sapiens
aattttttaaaagcaattttaggttcatagcaaaatttagcagaaagaacagagttcttatataccctttctgcttttccccaagcctcttgcactaataacgttctgtaccagagtggtatgtttgttacaatcagtgaacctagactggacacctcattatcacccaagaccaaggtttacgttaaggttcgctcttagtgttgtatattctatgagtttgacaaatgtttaatgacatgtatccaccatgatagtatcatacagaatagtttcactgccttcctctgtgctctgcctgttcatccctcccttcctgctgatcttctattgtctccatagttttgtcttttcccaaatgctgtatagttggaattatcatgtaacctttcaaattggcctttttcacttataatatgcgtttaaggttttctacatgtctttgcatggcttgatagctcatttttctttagtgctgaatactattccattgtttggatgcattacagtttattcattcacctactgaaggaaatcttgcctgcttccaagttttgtcaataaagctgctttgtaaaca

SEQ ID NO: 387261 - DNA, 524 bp, Homo sapiens
  misc_feature (347)..(347): n is a, c, g, or t
caaccattataggatttgggtgtgctctgtcttgtcttcatagttaactatcgtcaattatctggttatagacttccaatatttaatcaacaaatattgattgagtgcccacaaagtaacaggcagtggggggcaggctagactcagtcatcatctggagaagagagggaagtaagccgacaattacaataccgtggggtaatgtatgattagggaaatgccggacagagcagcaagtgcccaaaggtgttcagggaaatgaaacaagttattatttctggaacataggtcgcaaggtgggaagagatataggatgggaatgttaagccatgaggcagggcccaganccagcagagccttttcagctatgtttaagagtacagactttatttcaggagctatgaggagccttgtaagagctgcaagtagaagagtaacgtgctcaagttagcattttagaccactttggctgcaatatagagaacgaatgggatgaagtgaccctagggagtaggttcactctc

SEQ ID NO: 387262 - DNA, 292 bp, Homo sapiens
aaaattagccgggcatggtggtgtgtgcctgtagtcccagctacttgggaggctgaggcaggaaaattgcttgaacccaagagacagaggttgtggtgagccaagatcatgccactgcactccagtctgggcaacagagcaagactctgtctcaaaaataaataaataagtaaataaataaataaactaggtatttttttttttttatctaaagtggtgatgttttaaatgattgctttatatattggggtctaaatcttaaatatgtttaaattagacaaattctatttga

SEQ ID NO: 387263 - DNA, 216 bp, Homo sapiens
  misc_feature (10)..(10): n is a, c, g, or t
gaattctttnattattttaattaccaattacttccttgtctcagtgtatttttacccactagaatcacaagtgacatcattccttatttttatcctgctttgctttgatttcttacatagccttgatgtaaatcatttaaaaatcccatttaaaccacagaccagcagagcctggcagcctttggatttagtgctgttgaaccatacaggaaacta

SEQ ID NO: 387264 - DNA, 504 bp, Homo sapiens
tgcggccctgaacggcaacacggaattgatcagcctgctgctggaggcccaggccgctgtggacatcaaggacaacaaaggcatgcggccgctgcactatgcggcctggcagggccggaaggagcccatgaagctggtgctgaaggcgggctcggccgtgaacatcccgtctgatgagggccacatccccctgcacctggcggcccagcatggtcactatgatgtgtctgagatgctgctacagcaccagtctaacccgtgcatggtggacaactcggggaagacgcccctggacctggcctgcgagttcggccgcgttggggtggtccagctgctcctcagcagcaatatgtgtgcggcgctgctggagccccggccgggagacgccaccgaccccaacggcaccagccctttgcacctcgcagctaaaaacggccacatcgacatcatcaggctcctcctccaagccggcatcgacattaaccgccagaccaagtccggcac

SEQ ID NO: 387265 - DNA, 599 bp, Homo sapiens
  misc_feature (545)..(545): n is a, c, g, or t
tgcggccctgaacggcaacacggaattgatcagcctgctgctggaggcccaggccgctgtggacatcaaggacaacaaaggcatgcggccgctgcactatgcggcctggcagggccggaaggagcccatgaagctggtgctgaaggcgggctcggccgtgaacatcccgtctgatgagggccacatccccctgcacctggcggcccagcatggtcactatgatgtgtctgagatgctgctacagcaccagtctaacccgtgcatggtggacaactcggggaagacgcccctggacctggcctgcgagttcggccgcgttggggtggtccagctgctcctcagcagcaatatgtgtgcggcgctgctggagccccggccgggagacgccaccgaccccaacggcaccagccctttgcacctcgcagctaaaaacggccacatcgacatcatcaggtagagccggtagcagggagggcctcagccttagggtccccaggggtttcagcagcagcctggggcttcaggggcaccagtttttggctttnggggataaggggcgggacaagggcagggtcccaggtccctggttcaggcctctg

SEQ ID NO: 387266 - DNA, 297 bp, Homo sapiens
cgcccctggacctggcctgcgagttcggccgcgttggggtgagtctcctgtggagccctgtggggtggggctggggagccccacatcaggacccccctaccctgacccctccttcaaggtggtccagctgctcctcagcagcaatatgtgtgcggcgctgctggagccccggccgggagacgccaccgaccccaacggcaccagccctttgcacctcgcagctaaaaacggccacatcgacatcatcaggtagagccggtagcagggagggcctcagccttagggtccccaggggtt

SEQ ID NO: 387267 - DNA, 471 bp, Homo sapiens
gcaagtacaaaattaaataagtgagtactgttcatggaagtccctaccgagaaagggagaaacaaagagtttcaaagtatgtttcaggctgaaaacaaaaaagaaaacaaacaaacaaaaaagcttgaaaatgcattttgaggctgtgatcttccgttacaagactgtggtctgaagaccagtgggggttcctgacttttgtaagaactgcaatgagccaaccaacgactgccaaacctacctgaagaccaattagaaactctccctgcttcctaaaatgccacctttagtgggtccggaattggttctttccagtgggttcatggtcttggctgacttcaataatgaagccactgacccccgcacccttgggatgatgcagcaagaaacccctcaccagatggggtgcctcagccatggacttcccagcctccagactatcagccaaataaatgtctgttcattataaat

SEQ ID NO: 387268 - DNA, 516 bp, Homo sapiens
aaatttcaaagcagagctgaggggattttaaaagttccctggaaatgtgcctgatgccaggtagtcctgggcattaccaaatactcgtactacctaagcactgtggctgtgtaccacacacaggaaggattcactcaacatcagtttctctccttctggtctatcacatcccagagcattgagtgaatcctattgttctgggcacagcttagctgcaactctacagggagaccctcaggagcatggatgacatctcctctggctactgccagtatctgtatggctctgagaactcaatgggcatttgaatatccccaatgtttagctggtaagccaacccattttaattcactgttgtcattgtgggcagatgagatagaaaatgtctgttttcagataattccccagaaggggtgactggaagctagtgcagagacaaacaaggatgccggtggttcccaaactggagaggaatctttggggagccctcagccggagtactcaaggcccagccct

SEQ ID NO: 387269 - DNA, 622 bp, Homo sapiens
aaaaaaaaaaaaaaagctaagctccacaaaacttaagtgattcagtactgcctgattctttaattagcctgagagacttgtaatccaccaaaacttaactaggcagttaggcaattagtgtgctgtcttctctcatatcaaaaaggcttgaatcatggccattgtcattacttacaattatttctagtttttcatgccataataatggctaattatactggttaatcacaaaactcagccaatccaaattcactaataaatcagctaaaacaattagattgcaccatttataaatgtttagctacacacattttcacaggatctaggattaggcatttttctaaagctacatttgatggtttgggtcattctacctaagagcagctacaataatgttaatcaactccttggctgtgagccattattatgaaggaaaaaagttaagtgaacaaggtatcagcgaactcaatcacactacaaaatcatagactaaatggaattcaactcagacctcctttttgggttcaggaggctgttaacatatgctgtccaaggttggtgagagaaatgctgttctttaccccatcacagattctcagatcccctgagatttggggtgggt

SEQ ID NO: 387270 - DNA, 494 bp, Homo sapiens
gaacccatgtcgacccagaagaacattaagccaattggctttcaacatcacagtcaggtagttaagaaacaaaaggcctatgtttcccgttcaactaccatggtgaccttattataaaagatgaccagctaaaatttgatagcctaaaagaaatgacactgaagagtagtgagaagttctcagactgtattcttggagtactagggtactagggtctccaaggagcctctcaaggactgagagaggtggggaagtgaggtggacaagcaggtagggccgtacccccaactcccctgccaattcaagcaatgcagtgatccatttatctggatgagatagagatggaaagatagatagatagatagatagatagatagatagatagatagagatacatacatacatacatacatacatacatacatacatacatacagatatagatatacaagcttccagatgagcttctatttgttgaaaggattttgcagtta

SEQ ID NO: 387271 - DNA, 820 bp, Homo sapiens
ggattacaggggtgagccaccgcgcccagcgagacctgaaatgttcttttctggactcctggatttagaataactacaaactagttttgtttcactaatgttcaagaagaatttctagcgtcagtgaataaaggttcatgtcatagggtgtgagtttcactctgctacttgttttgacctggtgtgccaatgcagcaggtttccaagctgccccactagtaggagacatggcagtgagcacctgcaggcccctggggaagccaaggaaacccacactgattctgtgataaagcctgtgaaagctctgtgaaatgttaaaagtggtatgcaaatctaaggcatcattattattaagggagtttcggccacaccacatcaatggagaacctctttggtaattatgaaggaagagttatcatcacaatattattctttgaaaacacagggttgctttattgcagccctcacgggcacgtcttaaccatcactgtgctttctccctatgatgcgccccgttggtcttcctcggagacctcttatgttgtatttatactacttagaggactggacaataaggaaattggtgtattacattaagctggccgtacccccaactcccctgccaattcaagcaatgcagtgatccatttatctggatgagatagagatggaaagatagatagatagatagatagatagatagatagatagatagagatacatacatacatacatacatacatacatacatacatacatacagatatagatatacaagcttccagatgagcttctatttgttgaaaggattttgcagtta

SEQ ID NO: 387272 - DNA, 373 bp, Homo sapiens
agtgaatgataattttcccaggaactacaatggatgttttggagtggcatgatttatccacatattgcaatacagactttcaatcataggtgatgaaaaatagcaaactggtcttaaagtataaaacaaatgtactttcagtgattttcattgaatatgattgttgttattgagctttagacttctcaagtttgatttacatatgtaccccccaatataaatctgatttagcaaatgcatcttacccataattcaatacgcagttatttatattaaattgggcaaacagtaaaattttttggtgggatgaaccttgagagttttttattttatttttttctttttgaggcagaatctcgttctgtcgcccagg

SEQ ID NO: 387273 - DNA, 338 bp, Homo sapiens
aatgtatttattaatcaatgttcagggtgaactgttgatatataaaattaataatttgtttaatcataatatgaagcttattctcaaacttttcgttatgtgccttcactacgttttagaagtaataattttatactacatcattacaaaagccctaagtctcaccttaacaacatgccttcctccaatcataagtgtttggtgtacatatgcatataaaatattatcctaaggtggggcgcagtggaacccgggaggcagaggttgcagtgagccgagattgtgccactgcactccagcctgggtgacacagtgagtctccgtctcaaaaaaaaaaa

SEQ ID NO: 387274 - DNA, 395 bp, Homo sapiens
gttccttaagagtaggatctattcatttgttatctcgattccatagtgttgagtactagtaagtattgtgaccaaaatctaaacatagatgtgtttctttcctctattccgtactcattacagaatgggtcatgctaaggggggttattattttgttgttcagagtagaatccttttttgaatttgatctcgatagtgtgaaataaggaagagtcttatgtcacatgactatgcaccaaccactttgcatatattgattatcctcctcttcataagatgcagattattatgatcatgttacagagaaagacattgaaacccagagaggttaagtacaatttctcaggtcatgcagcttctgagtggcagagacagaattcaaacccaattagtca

SEQ ID NO: 387275 - DNA, 334 bp, Homo sapiens
gtttctacgttctgtacgttcacgtttgtcagcggaacccctgcttctgcgcggattgtgcgcagctgcagccaagcgtaagctgaaaattgtaaagttaagcgctggggaagcttgatttacgcccacgacgaggtcaggcagtctctgcgccctaaaggtcccgaaactccccagttaggaggtgttctggctctgtcaacttcgtgaatgccacctgaagctaagggaatacatcctttctttctttctttttttttttttaatgccaagagaaatgtttctgttgcacacagacattactgaaagtgttcgccagtaaggaccctaggct

SEQ ID NO: 387276 - DNA, 293 bp, Homo sapiens
taatgtggaaactgccattcatcacaaattgaacacacatcagaatgtatggcaattacgtttaaaaaaaaagttttactttggacatggtttaacagtgtaactggaaggaaacagaaagcaatatgtttttctactacatctgatgccatgcaatctctctgggatccaggttcactctaagttaggagcaatggttctctgaggacatttgaatacagaactagtaaacctgatacatttctccactgagtgaaggtaataacacagaagccatcaccacacacacagag

SEQ ID NO: 387277 - DNA, 131 bp, Homo sapiens
gcactgatctcactggtggagtgacccccagaaattaaagtaacctctttatgccttgattcctccccctccattgaggataacagtagcatcatgtcacaggggttctgtgaggatttaaagctaataca

SEQ ID NO: 387278 - DNA, 340 bp, Homo sapiens
atatgagtgccagctaatgccaagcctaagcttggcttggagctaccagtaatgcaaaatgaatatgaatggatacttaaaagatcttatagcctagtagagagagataagatctttatgtgaattattctcatgaaagaaaagtgataattaggaatttagagaacaaagattagatagactttgaagattaaacagctcttctatgaagtacatgatggtggtgcataggtttggggtctataatttggctgaccaaagactcttgtttatttcctgattcttaagccacgtttcacgttgttgaggtgctgaataaattgacctgtggataagtgaa

SEQ ID NO: 387279 - DNA, 1246 bp, Homo sapiens
taagaattttggaaatcctagtcattgaaatagagtggcatgcgtaaaatccttgttaatacagtaacttgatattcagcatggactgtacagtatttttttcttcggcttcaatatttgaattaatattttcctggtttttttagatgacacaaattatttatgacagcaatatcaaatccctcgttttttaacaagaaaatcttactcttctctgatggtcaattttgtcacaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttccactgttaacatt

SEQ ID NO: 387280 - DNA, 3058 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttccactgttaacatt

SEQ ID NO: 387281 - DNA, 2864 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtgg

SEQ ID NO: 387282 - DNA, 2477 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggggagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggacagacaagaggaagaagagagagaggagggagaagggaaagaagcaggaagagctcaacagctgaagaacctgaagaggaaggagattctgcctcttctatgagg

SEQ ID NO: 387283 - DNA, 1506 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagaggttaagcctcatgagcagtgggagcttatatactataaacaatgaaatgggaaaacaaaggaataaggacttcaattagagagaggaaatattctctcaattaaatttagagattttcc

SEQ ID NO: 387284 - DNA, 544 bp, Homo sapiens
attctcagaatatttattgcctgatgttacatgcaggaccacagagaccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttcctttttgctg

SEQ ID NO: 387285 - DNA, 558 bp, Homo sapiens
accaaggttaattgatttattctcagaatatttattgcctgatgttacatgcaggaccacagagaccatagagagtgtggaaagatcaatagagtaaattcaaggcagaatttgagggggataattataattgcagtatgagttaacatgtttatctgtttacaaatagatccatacaagtaacacttttataattctcttcattatttttgcattttagatatcggccttatgtatacttttggagatggtcgccacggaaaattaggacttggactggagaattttaccaatcacttcattcctactttgtgctctaattttttgaggtttatagttaaattggtaagggcatcacatttccctgtttatattttcatattactgtatttgagtctttcagtatttcatagaaaataagtaattttatgtttgtatggaagagtatcatatatatatctaataaatatacttgtttcctaaaagccaaatgtcagacattatgccattcagaaaatgtgttgctcctaattttcctcctttagcctcttccttttt

SEQ ID NO: 387286 - DNA, 2903 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagagtattctgccagtcactcccaaattgtttcagtttaaaaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtgg

SEQ ID NO: 387287 - DNA, 2735 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttccactgttaacatt

SEQ ID NO: 387288 - DNA, 835 bp, Homo sapiens
tgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaagtaagacacattttgaagtcatcatgttatctcccacttctatgttgttattaaattaataatgaaatgaaag

SEQ ID NO: 387289 - DNA, 481 bp, Homo sapiens
tgcgtatggtagatgctctgtaagtatttgttgaatgaatgggtttgttggaggtaagatgggtgccagggaaacctagtagaagctttagaagtcatccatgcaagaatagagaaagtctaaactagggttttggtaacagagatggggaggtaattggttgagaaatatttaggaggtagcatcaataggacttggtaattgaaaaaagagggagcatgtgaatgaaagaagaaataaagatgacttctctcttgcacatctaatgaatagtggtgctactaagttagatggagaatccaagtagaaactaatgaaatcaattatggatatgatacatttgaggttcttctggaacatctagatggagatggatatatgggtctggagcttggaagagatgtctgtacttacataaattgggagttggtatccagctagtaattgctcagaaagaatacacataagaagaagataagta

SEQ ID NO: 387290 - DNA, 974 bp, Homo sapiens
ctcatgatccacccgcctcggcctcccaaagtgctgggattacaggcatgagccactgtgcctggcctcggctttaattttcactgtgttttttgtttgtttttatagagatgagatcttgttatgttatccaggctagtctcaacctcctggtctccagctatcctcttgcctctgcttcccgaaaaagcactgagattacagataggaaccagcatacctggccctatcttcattttgaaaagccatttctttaggacatattttcctgatactttttcccaaaaccaaaattatgactgaaattgcctaatccaatgacatcttcatggctgttatctaacacataacattagtgtatagattcattcctttccagactataagctccatgagaggagtcatgtttcttttattcacagttgaatttgtgacactgagacatccagtaaatctttgtaaactgaataaataaatcttgaatatatgaacaaaatttgatagcacgaactaaaggctgtaaatgtgaatagttaccatttaaaaattaagcttttgtagtaaaatttatgaaatatgcttctaaggaagctatattctttactgtgtattccgtttgcattgagcaacacaacaagcttgaaacaagagtgcctttactcttaaaactcaccaataaattctacttccctgtccagaaaaaacagaaaaaagacacataaaagcataacaaaatgaaatacacgcagcaagctacaaaagaggggggggccgcaagaaaaaagactcccaggagggggccaagtgcgcgagcgaccgttcgtaaaccagggccccacagagggggccgtatcaaaaggagcagggaggccgaaaaacacgagcgcggaaaacacgcggagaatggggaagcacacaactgcggggacaaggggaaccacaaagagaaagcccggggataaaaaggggggcag

SEQ ID NO: 387291 - DNA, 485 bp, Homo sapiens
atccctcctgtgaggatgaaattgaaaactccggtttctggcttggcgatcgggtgaccgagcagccgcgaggtgacagcgccggcggcccgcgggcggggaccggctgggatagaggcgcgttgttctctgagcgatgtttaccgagaagcccgctccgcggcacgggcgggtgtcagttgggaccccaaccctgggtcccgcggctcctagcccggggcctgcggtgtagacgggggttggggacaggcccagctggccctgaccgggtgtcgggcgcccagagatgccgcgcgggaggagccgcgggagagccgccggactcagcgagcagagggtcgtggagcctgatggatcgatgagatctgaaaaagaacactgtgcgagattgtattcctgcttattctttccaagttagtaggcagattggaactatagaatttatccgtgataataataaagttcgcataacttttgttctgaaa

SEQ ID NO: 387292 - DNA, 680 bp, Homo sapiens
cccagtcagtcgggcccaggtggggatcaggaggtttcaggaaaacacaagctatgcagtggggcaggtgaggcttggcctgcccagcctgtcctgagtgtcatgggaacagctctggaagtgactcctctgtcctctggaatctggatcagatggggccttctccagacatctgtgctcagcagatgcgacagacggcccctcgagtgtagcccaggatccagcaccggcccaagcaggtgggagctaaggggaaaccgaggctcacagcgaggaacttggtcaacaagcccaggcccctccaccctgcccgcgtttcctgcactgcactggatcaaaccggtttgatccttgataatgcctccgacaaatatttgatgagggaggaggctgagagaggggctgtggaacaaatcaccacaaactggagggccgaaaacaccagcaatgggctccctcttggttctggagccgagaaggcagaaatgaaggcgtcatcagggttgctccttctggggcctcagagcaggactctgttccctgcccgtccccagctccggtggttggcggccttcctccgcctgtggccctgcactccaatcgctgcctctgttgtcacttggccccccatgtgcctctgtgtctcagaaggacacaagtcatattgaattaaggaccct

SEQ ID NO: 387293 - DNA, 335 bp, Homo sapiens
catgggaccaggactcaatctctgaataactgaatccttggcttggtggaaagagccactctcacataataacagagaagaagcaaggtgtggtggctcatgcctatagtcccagcattctgggaggtggaggcgggatgatcacttgaggccagcctgggcaacatatcaagaccctctctccacaaaaaataaataaattagttgagcgtggtgtcacgcacctgtaatcccagctactcaggaggctgaaatgggaggatcgctgaagcccaggagtttaaggctgcagtgagctatgatcacgcaagccactacctctaaaaaataaaaat

SEQ ID NO: 387294 - DNA, 300 bp, Homo sapiens
acagacgcagtcaactcacctgccagagttttgcttgccccaacacttagcaagaagctgaatgcatccaaggatccccacaatcccagaacattctaaaaatattgcaggatgagaaagaattgtcagcaactgagggaggaagttgttcaacttccaccaagcatcaggctgaggcaggagaatcgcttgaacccaggaggtggaggttgcagtgagctgagatcgtgccattgtgatatgaatatgccttatatgctgatatgaatatgccttaaaataaagtgttccccacccccg

SEQ ID NO: 387295 - DNA, 338 bp, Homo sapiens
cttgtgttctttctaagtagctcggccataatatcacttttctttagcagcattctaacttctaagaggcttaataggcaaggagattgtggggtctttgacttcctctgcgtcttagccctaagtggtttattctattaagctgattcttggtggtggatagagctttgctggataagaagttggggtcggggaaagttgcagttggaggaattggatactttcactcccccttccactgtgccccaccctccaacccactcctgccccattctgtttttagagcttttgaatgaaggaagtggtgatgaaattaagtaaagaactcttcttagagg

SEQ ID NO: 387296 - DNA, 394 bp, Homo sapiens
ctgcgttccatgtagcgtcttccacagttctctgttataagatggtttgttacattgctgcagatatttctgcatgtctcttgagtttctcaagaccagggttgtattttttcatgtctgtcgatgaaacagtacatgacaaaagaaggtacttaatacatgtttgataaattaattactgtttggtaaattaattattgaaggaagacccagactggttctgataaatcattgattacattttacaaatttgtataaattaggggagccttgagaagttagagctctagggaaggttccaggaacgttgaaggatgtgaaatatgttttcaaattcatagttattgcagattctgaatacttccaagtgagggaagatgagaagagatggctt

SEQ ID NO: 387297 - DNA, 209 bp, Homo sapiens
cttgttaggctagggatgactgtcttccaggagttgaatgtggcttggataaggttttggaagaaaatgagagtaaagtagttggatttggcaggaagttaatagtacagactttataccaaagagtgtaacattatcccaagactgtggctagaggaggtgaatctatctgtgactgcccagtcaggttggtgggatgggggaaacat

SEQ ID NO: 387298 - DNA, 2558 bp, Homo sapiens
taatagtcacatgacacgtttcccgtcaagatggcggatactctcccttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccagtcaggatttgcatgaagatgtcgaagaagctggtgcactgcagaaaaatcatgctcttgtgacatctgcaaactccacagaagctgcagattctgccttcctgcctacggaggatgagtcattaagcactatgagctgtgaaatgctcacagaacaaactccaagcagcgatccagagaatgcgctagaagtaaatggtgctgaagtgacaggggaaaaagaaaaccattgtgatgataaaacttgtgtgccatcaacttcagcagaagacatgagtgaaaatgtgcctatagcagaagataccacagagcaaccaaagaaaaacagaattacttactcacaaattattaaagaaggcaggagatttaatattgatttagtatcaaagctgctgtattctcgaggattactaattgatcttctaatcaaatctaatgttagtcgatatgcagagtttaaaaatattaccaggattcttgcatttcgagaaggacgagtggaacaggttccgtgttccagagcagatgtctttaatagcaaacaacttactatggtagaaaagcgaatgctaatgaaatttcttacattttgtatggaatatgagaaatatcctgatgaatataaaggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggatgtgtgctgtgtttggtggaatttattgtcttcgccattcagtacagtgccttgtagtggacaaagaatccagaaaatgtaaagcaattatagatcagtttggtcagagaataatctctgagcatttcctcgtggaggacagttactttcctgagaacatgtgctcacgtgtgcaatacaggcagatctccagggcagtgctgattacagatagatctgtcctaaaaacagattcagatcaacagatttccattttgacagtgccagcagaggaaccaggaacttttgctgttcgggtcattgagttatgttcttcaacgatgacatgcatgaaaggcacctatttggttcatttgacttgcacatcttctaaaacagcaagagaagatttagaatcagttgtgcagaaattgtttgttccatatactgaaatggagatagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatt

SEQ ID NO: 387299 - DNA, 1643 bp, Homo sapiens
cggagaagaccaaggagggcgtcctctacgtcggaagcaagaccttgttcatcaggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggatgtgtgctgtgtttggtggaatttattgtcttcgccattcagtacagtgccttgtagtggacaaagaatccagaaaatgtaaagcaattatagatcagtttggtcagagaataatctctgagcatttcctcgtggaggacagttactttcctgagaacatgtgctcacgtgtgcaatacaggcagatctccagggcagtgctgattacagatagatctgtcctaaaaacagattcagatcaacagatttccattttgacagtgccagcagaggaaccaggaacttttgctgttcgggtcattgagttatgttcttcaacgatgacatgcatgaaaggcacctatttggttcatttgacttgcacatcttctaaaacagcaagagaagatttagaatcagttgtgcagaaattgtttgttccatatactgaaatggagatagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatt

SEQ ID NO: 387300 - DNA, 1318 bp, Homo sapiens
acctactaacccacttcctgcttatcctggatatttcatgtgtatatactattgaataactatataatttatcaagttggtttgtccatttgaaacataaggaaatcaatttatgttatcttctctatagggaaaattttaggatgaatgtgatcataaaccctttgatactagtgagaagaagtaatagaagtccaaaggagcatgactggagtaaaatctaattaacttactaatcaaaatagagtgtgtagatgcaaatttactaaatgtttacatacgaagctctgatttcctactatgtctagtcatggcttaatcggtaataggctacacagtgtagtaattgacaaacatattgtattttagaatgtaaataaaatttatttctatatttagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatt

SEQ ID NO: 387301 - DNA, 903 bp, Homo sapiens
cccccgggctgcaggattcggcacgagcttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaatgtaacactcaccgcgaagatctgcagcttcactcctgcgcccaccgagaccacaagcccaccgggaggaacgaacaactccagacgctctgccttaagagctgtaacattcaccgcgaaggtctgcagcttcactcctgagccagcgagaccacgaacccaccagaaggaagaaactccgaacacatctgaacatcagaaggaacaaactccagacgtgccaccttaagagctgtaacactcaccgcgcgggtccgcggcttcattctttaagtcagtgagaccaagaacccaccaattccggacacaccgatagcattctaatattttacatttgattgcaaggaggactaggcgagaattcaaatggattagtgcaaacccattaccactgcttggaaaatacgtcaaagtatttgggcaatataattctaatatatgtattctaatataaatatatagggtgtatttatatattatgtattctaatataaatatataggatagttattttttgattaccatgacttatttaaaaagtattctgaagtattattcaacttaaaggttttcatgatcatttcaacattaaatttaatacgttgggtattg

SEQ ID NO: 387302 - DNA, 436 bp, Homo sapiens
cccccgggctgcaggattcggcacgagcttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccaggtatgaaaagtatttactgcaggtaaactaaattaatgactttttcactcttctttagaagaagccaacaataaagatttatgtggcattggttgctacaagtcacgttaa

SEQ ID NO: 387303 - DNA, 1878 bp, Homo sapiens
cgaattccgattaaagacatctgctctggaacacggaacctgttccactcgtccttctcgaaatgcaagaatcctggtaatatttttaaactctgcatatcgactaacattagatttgattagaagatcaattagtaatcctcgagaatacagcagctttgatactaaatcaatattaaatctcctgcatgtctttaatagcaaacaacttactatggtagaaaagcgaatgctaatgaaatttcttacattttgtatggaatatgagaaatatcctgatgaatataaaggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggatgtgtgctgtgtttggtggaatttattgtcttcgccattcagtacagtgccttgtagtggacaaagaatccagaaaatgtaaagcaattatagatcagtttggtcagagaataatctctgagcatttcctcgtggaggacagttactttcctgagaacatgtgctcacgtgtgcaatacaggcagatctccagggcagtgctgattacagatagatctgtcctaaaaacagattcagatcaacagatttccattttgacagtgccagcagaggaaccaggaacttttgctgttcgggtcattgagttatgttcttcaacgatgacatgcatgaaaggcacctatttggttcatttgacttgcacatcttctaaaacagcaagagaagatttagaatcagttgtgcagaaattgtttgttccatatactgaaatggagatagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatt

SEQ ID NO: 387304 - DNA, 977 bp, Homo sapiens
taatagtcacatgacacgtttcccgtcaagatggcggatactctcccttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccaggtccacgctgcttttatgagctgtaacactcaccgcgaagatctgcagcttcactcctgcgcccaccgagaccacaagcccaccgggaggaacgaacaactccagacgctctgccttaagagctgtaacattcaccgcgaaggtctgcagcttcactcctgagccagcgagaccacgaacccaccagaaggaagaaactccgaacacatctgaacatcagaaggaacaaactccagacgtgccaccttaagagctgtaacactcaccgcgcgggtccgcggcttcattctttaagtcagtgagaccaagaacccaccaattccggacacaccgatagcattctaatattttacatttgattgcaaggaggactaggcgagaattcaaatggattagtgcaaacccattaccactgcttggaaaatacgtcaaagtatttgggcaatataattctaatatatgtattctaatataaatatatagggtgtatttatatattatgtattctaatataaatatataggatagttattttttgattaccatgacttatttaaaaagtattctgaagtattattcaacttaaaggttttcatgatcatttcaacattaaatttaatacgttgggtattg

SEQ ID NO: 387305 - DNA, 422 bp, Homo sapiens
gaattcaagtccatcctgagcaacatggtgaaaccccatctctacaaaagatatgaaaattagccggatgtggtggcacacacctacagtcctagctacttaggaggctaagatgggaggattgcttgagcttgggaggcaaaggttgcagtgagctgagactgcgccactgacgaagcgagaccctgcctcaaaaaaaaaaacaaaaacaaaaacaaaaacaaaactcaaacttcacacttgagatctgtgcaatttactgtatataaattatactttaaatagttaagtggtcggctgggcacggtggctcacgactgtaatcccagcactttaggagaccaaggtgggcagatcacgaggtcaggagatcaagaccatcctggctaacatggtgaaaccctgtctctactaaaaaatac

SEQ ID NO: 387306 - DNA, 927 bp, Homo sapiens
  misc_feature (68)..(68): n is a, c, g, or t
cggcggcgggcccaaggcgtgaggcgccgcccgggtgtccccgcggcgcaggaggcggtggagcgcanagcgggcgagcgcgaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatg

SEQ ID NO: 387307 - DNA, 295 bp, Homo sapiens
tcctgagtagctgggactctagttgagttgttcagaccaaaactcttggaatcctccctgatgccagttttcaattaaacaggaaattctggcagctctatctttaaaatatacagaaatgtgcttctcaccaccctggtctcaaccatcattatttctggcctagattattgcagtaacctcctaacttgcctttctgctgcttcccttgctcctcacaacccattccccatacagcatcctgttaactttttaagacgttaaatcagtcatcaactcaatcatgtgacttctc

SEQ ID NO: 387308 - DNA, 404 bp, Homo sapiens
aggtcacacgcccacaggactggaaaacagtgaactagacaacctcagcgctctggcgcttccagaaaaccgcgtgtcactgcagcatcctccgcatcatccagcaaggagggaggtgactgtcatccccatttacaagggaggagacagagcagggggctctagatgggccgccccatgaagtcagccagtcagcccaagcacctggactcggatctcccaaacctcatgcgatttctactccatcgcactgcctttccacgtggctttcaaagtcattgctaagccttgtttccatgatgccacactcaagttttaggtgaaaatctattacgaaatggaaactttttttggaaactatactgctgcagaaaatgcgcacactgtctagagtctttgttccg

SEQ ID NO: 387309 - DNA, 429 bp, Homo sapiens
tgctttttatatttagaagcctcccttttgggtgcataaatatataaagctatattctcttgagaaattaacctctattattgtatggtaaactcatttcattcttgtgagagacattgctagaaagtctattttgtctaatttaagcattaccatttcactcctttggttattatttgcatggaatatcattttctatcctttcacttttagcctatgctcttaattcataattgagtctcttgtaagcagcatattatgaggtttaaaagattaatttatccactctgtctgctttagtctcttttggctgctataacagaatatcacacactggtaattaataaagaatagaattttatttgactcatgattctggaggctgggaagccaaaacaacattatactggtatatgttgaaggtctagt

SEQ ID NO: 387310 - DNA, 341 bp, Homo sapiens
tcctacaccagctctgcctgtgctgcctcacccttctctccctggagaaaggcccctccaagaggctgttgcttttctttgttggcttctggtagatgtgctcctgaaggcaactgtctcaaaggtgggaggaggcagcgcacttgccagtgtggctcgggttatgaaagcacaggcttttagtcccctgctgaggatcctgcacaaagcctctacttccagcttcagggccaggaaagactcagcccacacacccagttgcctcttgaccccttcagggccagagagagcaggtccactcactcaggactcatgtcagccttctccccacgactccttca

SEQ ID NO: 387311 - DNA, 825 bp, Homo sapiens
ggcggtgtctccggggttgggcacacgagagtagcgggcagaagccaacgcagggttgggatacgtggggccacagccagtctctgtggtccccgggtctaggcttagcaccagttacagcaaccagacatccaacaggtgtttaaacctgttttttctgtaggctaaattcacatccgtttgtcaagaggggattgtcaacctctgtccagcgtctctttccgctgcaggaccatcccaagatgaacttaaaggacagccttgatgtggcaaagccggcggacgccaagaatggcaattccatccgcttggctttgacagtgtcagaagcatgatgcctgacgattgcgcatgagggtcggccccttgcggcagcggtggggtgcactgcctccatagtacaccgctgcccgctgcttggattctggtgggcccacctcatgctgatttccaacacctgaggttgtgggagttgaagagtttccagttgtggctcagtcactaactagtgctgagactgcgaggcacttcagctctctgagtgtcagtttcctcatctataaaatggggccgatatcctgcccttcctactcacctaggagagcgtaggtatgaaagccttccaacgtccccagcatatgtaagggataacctttatacatttaattagaaccaaataggtgaaggctgcaaagagccaggtgctcattacttttaggaaatcttcagtacatctgttcccacactgggactatgatcaggtttgcggcatgtaagagaagggtgaggcaaaactccctcatcaaacttgccatcaggataaag

SEQ ID NO: 387312 - DNA, 2574 bp, Homo sapiens
tataaaattattagtataaaaggggagatgctaccattcgctcctcaggacgagccctgggaccgagaaatggaagtgttcagcggcggcggcgcgagcagcggcgaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaaggatttgctttcccatatgcttcatatggacccacatcagcggtatactgctgaacaaatattaaagcactcatggataactcacagagaccagttgccaaatgatcagccaaagagaaatgatgtgtcacatgttgttaagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattttttttctt

SEQ ID NO: 387313 - DNA, 522 bp, Homo sapiens
gcggtaggcggcagctcctgtttgagtgctcctgaaggggagatgctaccattcgctcctcaggacgagccctgggaccgagaaatggaagtgttcagcggcggcggcgcgagcagcggcgagtttgctggctgggaacattttgggggacagctgcggactccagctcgctgttgaaccccggacgctttacgaacccagtgcaacaaacacaccaagaaagttggatccttttctgataacttaatcgactgcgtactactccagtagaggccaccatacacctcctaaaaatagttggtgaaattgattcacagtaggatattttgagtatgttttaggtattgtagagatttaacaatgggtctctctacctcagcaatttggaaaaatactcgagtggaaattgttaatccctatgaagtaaaacgaaaggtgaaggtaaatggtcttaaaatggttgatgagccaatggaagagggagaagcagattcttgtcatgtaagtatttatgttaattta

SEQ ID NO: 387314 - DNA, 2766 bp, Homo sapiens
gcggtaggcggcagctcctgtttgagtgctcctgaaggggagatgctaccattcgctcctcaggacgagccctgggaccgagaaatggaagtgttcagcggcggcggcgcgagcagcggcgagtttgctggctgggaacattttgggggacagctgcggactccagctcgctgttgaaccccggacgctttacgaacccagtgcaacaaacacaccaagaaagttggatccttttctgataacttaatcgactgcgtactactccagtagaggccaccatacacctcctaaaaatagttggtgaaattgattcacagtaggatattttgagtatgttttaggtattgtagagatttaacaatgggtctctctacctcagcaatttggaaaaatactcgagtggaaattgttaatccctatgaagtaaaacgaaaggtgaaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattttttttctt

SEQ ID NO: 387315 - DNA, 728 bp, Homo sapiens
ttctgaccaggtgcagtggctcatacctgtaatccagcactttaggtggctgaggcaggttggatcgcttgagctcataagttcgagacagcctggccaacatggtaaaaccccgtctttactcaaagtacaaaaattagccgggtgtggtggtggctgcctgtagtcccagctacttgggaggctgaggcaagagaatcacttgaacccgagaggtggaggttgcgggagccaagattgcgccactgcactccagcctgggtgacagcgcaagactccatctccaaaaaaaagatgaataacttgcctaaagacacacaactagtaagtgtagagtctggttttgaacactcagcccagatctttctgctttcctgaccatgcgtccagaaacatgttcccaccaagaaatttttgtcttctggaccctttccaagatgtaactctaactacctggacattctgaattctgcttctgggtagttggtaggacaggtaaacagcattcttggagccaacagacaccagccatgcaaataccctctttctgtggacaggatagttttacttaagataaatgcttccactcaccagttttcttcaattctatctcctttctgaccatctctgtgcttgggaaagtagctcttatcaaacacaggagaactgatcatattgctgtttatttaaaatccggtgtaatgtggaatttttgcaatgtttcagga

SEQ ID NO: 387316 - DNA, 355 bp, Homo sapiens
tgagtttttttttaaaaggtcccttctaaaaaagaggggctacattttctcccgccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgtttttctgatgaatggcttgatttttctccttgacatgttttgactgttcattctaactgaaaacatatatgggaaaatatgaacctgaaataaaagcactcaaattcaa

SEQ ID NO: 387317 - DNA, 4678 bp, Homo sapiens
  misc_feature (825)..(825): n is a, c, g, or t
  misc_feature (841)..(847): n is a, c, g, or t
  misc_feature (859)..(859): n is a, c, g, or t
  misc_feature (870)..(870): n is a, c, g, or t
  misc_feature (873)..(873): n is a, c, g, or t
  misc_feature (875)..(875): n is a, c, g, or t
  misc_feature (895)..(895): n is a, c, g, or t
  misc_feature (901)..(901): n is a, c, g, or t
  misc_feature (904)..(904): n is a, c, g, or t
ctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagtnatcatcattggcctannnnnnntagtaacgacantcacaggtatntcnangtctgctatttgccacgaanggagtngtnagaggaggtggggcctactatcttatttccagaagtttagggcccgagttcggtgggtcaataggcctgatctttgcttttgctaatgcagtggctgttgctatgtatgtggtgggattcgctgaaactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgcaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagatgatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatggaaaccaccaatgtgattgtaaacttctccagacaaacttaaccttttgtttcttaattttttgtttgagtgtttgcttctcagccctggtataggtctcagccccacagcaggatctcaataaatgcttattgacaggctggcatagtaaccacaggtggttatcaaaggaaaagaccaataggctggggaacataattatgcttggcccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgtttttctgatgaatggcttgatttttctccttgacatgttttgactgttcattctaactgaaaacatatatgggaaaatatgaacctgaaataaaagcactcaaattcaa

SEQ ID NO: 387318 - DNA, 1742 bp, Homo sapiens
  misc_feature (825)..(825): n is a, c, g, or t
  misc_feature (841)..(847): n is a, c, g, or t
  misc_feature (859)..(859): n is a, c, g, or t
  misc_feature (870)..(870): n is a, c, g, or t
  misc_feature (873)..(873): n is a, c, g, or t
  misc_feature (875)..(875): n is a, c, g, or t
  misc_feature (895)..(895): n is a, c, g, or t
  misc_feature (901)..(901): n is a, c, g, or t
  misc_feature (904)..(904): n is a, c, g, or t
ctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattggtcttggagtnatcatcattggcctannnnnnntagtaacgacantcacaggtatntcnangtctgctatttgccacgaanggagtngtnagaggaggtggggcctactatcttatttccagaagtttagggcccgagttcggtgggtcaataggcctgatctttgcttttgctaatgcagtggctgttgctatgtatgtggtgggattcgctgaaactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggtacgttgtttgctctgctttgcagtcctgggagtggtggtacacttggtgggtagcacaaggagctagagaggttagatgtgaccatattaccctacagattcaaactgtaggtttctgcaagatttcctgatgatttaaaagttctctcttttaatgccaaatttggatttatattccagataattcttccaaaagtcttattcagtgatatcagaagaacagggtagtgtgatagtgtgtcatatttccccaaaataaatgtagttcagtgaaaaaaataccagaaccaccctttctcttttaaacccaaatgaataggaatattttcctgtaaaag

SEQ ID NO: 387319 - DNA, 519 bp, Homo sapiens
agttatagaacacaggattagatgcctccagaaaagctacagggagttaattgtatgcccagtcgcacatctacccattgccacttgaactttttgtagtagaggtctcgattgtctattttctgattggtaggcttttttattacttactttatggaaaccctagctaagagtaaatatgtatccccaaagaaaaatgactaacttcttaaactttgacagatgctcgctatgttttcaatttccaaataaattcaagcttcgaggctataacagctgttcagcccctggtctcatcactcatacgtacatgttcaattctgttacttttacagcggaactgaacaccattgctcccatcatctccaactttttcctggcctcatatgcacttattaatttctcctgcttccatgcctcttatgccaaatctccaggtaagctgacttccaaactaaaatatgcctaagcaaacagttagtttgtctcaataaaacgaaataaatcagtgaaaagtgt

SEQ ID NO: 387320 - DNA, 654 bp, Homo sapiens
ctataatcccagccctttgagaggctgaggtgggcggatcacttgaggtcaggagttcaagaccagcctggccaacatggtgaaaccccgtctctactagaaatacaaaaattagcgaggcgtggtagcaggtgcctgtaatcccagctactcggtaggctaaggtacaagaatcgcttgaaccgggaggcagcggttgcagtgagccaagatcgtgccactgcactccagcctgggcgatagagcgagactgtctcaaacaaacaacaacaacaagaaaaggaatgtgagaatgaagcagggggaaaaaatgtagttgaaagccgtttgcttatgaaacagattccaaatcacagaaagtctccttacttgtacctctcttctcaaggtcatgagcatggtatcagggttcggccccctcatcactgcgggaatcttttctgcaacactctcctccgccctggcctcccttgtcagcgcacccaaagtgttccaggtaatacaagcacaacagcttgtgcttctccctattgctatttccacagaatgtgaatcaagctgaaatattcgttctcactggcaatcattttccatcattttctgaaacagttaatgtttgcatctggctcaagttctatgtctgccacatagtca

SEQ ID NO: 387321 - DNA, 721 bp, Homo sapiens
gactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaaggtaagcttgaaggacacaagcaagtctcctcccttattcataacttcagataatttccttctctttcattacactatgaatgaatgtgaaacagtcaaatggagaggtctattccaaacactatccatcttacttacaaaactgtccctagttcccagaaaagtgtttcacagatgctttttctttggatttttttttttcttgagacaaagtcttgctctgtcacccagcctgaagtgtggtggacactgcagctttgaactcctgggctcaaacaatcctcccacctcaacctcctgagtagctgggactgcaggcatgcaccaccacacctgactaacttttttattttttgtagagacagggtcttgctatgttgctcaagctggtctcgaactcctgacttaaagggatcctcccaccttggcctcccaaagagatgggattgcaggcatgagccactgtgccca

SEQ ID NO: 387322 - DNA, 929 bp, Homo sapiens
ctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccaccacattatgaagaaacctcttttggggatgaagctcagaaaagactcagaatcagctttaggcctgggaatcaggagtgctatgacaatttcctccaaagtggagaaactgctaaaacagatgccagttttcacgcttatgattctcacacaaacacatactatctacaaacttttggccacaacaccatggatgccgttcccaagatagagtactatcgtaacaccggcagcatcagtgggcccaaggtcaaccgacccagcctgcttgagattcacgagcaactcgcaaagaatgtggcagtcaccccaagttcagctgacagagttgctaacggtgatgggatacctggagatgaacaagctgaaaataaggaagatgatcaagctggtgttgtgaagtttggatgggtgaaaggtgtgctggtaagatgcatgctgaacatctggggagtcatgctcttcattcgcctctcctggattgttggagaagctggaattgagtatccttcttggcatgattggtaaaacttcactgaacaaaaataacttgtgagaaaactggtgaaaatgtgacctgactaataaaaatgctgaattgttgaactttttccaaa

SEQ ID NO: 387323 - DNA, 3864 bp, Homo sapiens
ggtcttggtgtgattatcatcggcttagccgtgacagtgactggtatcactggtttatccacctctgctattgccacaaatggatgtgtcagaggaggtggggcctactatcttatttccagaagtttagggcccgagttcggtgggtcaataggcctgatctttgcttttgctaatgcagtggctgttgctatgtatgtggtgggattcgctgaaactgtagtagatcttcttaaggagagtgattcgatgatggtggatccaaccaatgacatccggattataggctccatcacagtggtgattcttctaggaatttcagtagctggaatggaatgggaggcaaaggcccaagtcattcttctggtcattcttctaattgctattgcaaacttcttcattggaactgtcattccatccaacaatgagaaaaagtccagaggtttctttaattaccaagcatcaatatttgcagaaaactttgggccacgcttcacaaagggtgaaggcttcttctctgtctttgccatttttttcccagcagctactgggattcttgctggtgccaatatctcaggagatttggaggatccccaagatgccatccccagaggaaccatgctggccattttcatcaccactgttgcctacttaggggttgcaatttgtgtaggggcctgtgtggtccgagatgccaccgggaacatgaatgacaccatcatttctgggatgaactgcaatggttcagcagcatgtgggttgggctatgacttctcaagatgtcgacatgaaccatgtcagtacgggctgatgaacaatttccaggtcatgagcatggtatcagggttcggccccctcatcactgcgggaatcttttctgcaacactctcctccgccctggcctcccttgtcagcgcacccaaagtgttccaggctctgtgcaaggacaacatctacaaagccctgcagttttttgcaaagggatatgggaaaaacaatgaacccctgagaggatatattctcacttttcttatagccatggcatttattcttattgcggaactgaacaccattgctcccatcatctccaactttttcctggcctcatatgcacttattaatttctcctgcttccatgcctcttatgccaaatctccaggatggagacctgcgtatggaatttacaacatgtgggtatctctttttggagctgttttgtgctgtgcagtcatgtttgtcatcaactggtgggcagctgtcatcacctatgtcattgaattcttcctttacgtctatgtgacttgtaagaagccagatgtgaactggggctcctccacacaggctctttcctacgtgagtgctttagacaatgctctggaattaaccacagtggaagaccacgtaaaaaacttcaggccccagtgcattgtcttaacagggggacccatgacaagacctgctctcctggacataactcacgcctttaccaagaacagtggcctttgcatctgctgtgaagtctttgtgggaccgcgcaaactgtgtgttaaggagatgaacagtggcatggcgaaaaaacaggcctggcttataaagaacaaaatcaaggctttttatgctgcagtggcggcagactgtttcagggatggtgtccgaagtcttcttcaggcctcaggcttaggaagaatgaaaccaaacactctggtgattggatataagaaaaactggaggaaagctcccttgacagagattgagaactacgtgggaatcatacatgatgcatttgattttgagattggcgtggttatagtcagaatcagccaaggatttgacatctctcaggttcttcaggtgcaagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaagatggcagcattaacacaagccagtcgatgcatgtgggagagttcaaccagaaactggtggaagccagcactcaatttaaaaagaaacaagaaaaaggcacaattgatgtttggtggttgtttgatgatggagggttaacacttcttatcccctatatcttaactctcagaaaaaaatggaaagactgtaaattaagaatctatgtgggagggaagatcaaccgcattgaagaagaaaaaattgcaatggcttcccttctgagcaaatttaggataaaatttgcagacatccatatcatcggtgacatcaacattaggccaaacaaagagagctggaaagtctttgaagagatgattgaaccatatcgtctccatgaaagctgcaaagatttaacaactgctgagaaattaaaaagagaaactccgtggaaaattacagatgcagaactggaagcagtcaaggaaaagagttaccgccaagttcgactgaatgaactcttacaggagcactccagagctgctaatctcattgtcctgagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagatgatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatggaaaccaccaatgtgattgtaaacttctccagacaaacttaaccttttgtttcttaattttttgtttgagtgtttgcttctcagccctggtataggtctcagccccacagcaggatctcaataaatgcttattgacaggctggcatagtaaccacaggtggttatcaaaggaaaagaccaataggctggggaacataattatgcttggcccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgtttttctgatgaatggcttgatttttctccttgacatgttttgactgttcattctaactgaaaacatatatgggaaaatatgaacctgaaataaaagcactcaaattcaa

SEQ ID NO: 387324 - DNA, 450 bp, Homo sapiens
cttaaactaatattgtttctctgacctactcatttcaggaaacaaaagactacaattgcctttatgctgatatgcccttatattgaagacttgaccatatataggaacattaaacagaatgccaggtagaggttttgattttcttgtcaaaataaaatgtcagaaatattcttcatgtgttttggggaagggagtattaataggggtcaactgtacattagtgaatacctgtcatttgaaataggagcttttaaaatagtatatatttaaggtgtaaaacatgatattttgatatacatatacatagttaaatgattactacagtaataggagcaataattttatgtgtgctgttctaagcacttatggtaactcattttatgttaacaacaatcctgtgagatgggaatatttatcctccatctgaaaaaaattaaggcacggagagac

SEQ ID NO: 387325 - DNA, 2351 bp, Homo sapiens
ttcaaacagtgctcattcctcaactcccaagtagctgagattacaggcatgcaccatcacgcctggctaatttttctatttttagcagagatggggtttcgccatgttggccaggctggtctcgaactcctgacctcaagtgatctgcccgcctccacctcacaaagctttgggattacaggcatgagccacggtgcctggcctgcagcctcctttattttacaaaaggcattaccacttaaacactgaagatagcacgaatctctgatgtttgcaagttcagaataaaatggaaatgaaaattcattatgtggcagtctcagtactgagcacaaaggcttttaaccacaagcaaattactgtgctagccagaccgtgtgagagaactccaggccagcttgctaaaactgagcaggagaatttggagagagtccagaggagagccacagaaacaactgaagcatgacaagaataattgcagttctgttatagagaggtcatctatatcaggcttttatggagtaccatgtggaatgttaccacgcagagcatggggaacagctgttgtgactcaacaagagacaggacagaagaaatgagaacaggtggaagatcaataatttaggtttgatatggggaaagatggaacagtcaaagggattcacactgatttttggctgagcagaaggcagagtctcctccaacgggcaatgtaagtgcccccactcatctacaccccgagaagagccatcaaactgtattaaacttggaaaaagctatttaacttcaagtgtgctgcgagaaaacttcataatagttcctaagatgtgctaaaaagtaaagtccaaaaagatcataaagtctgtagagaagttctaagagtgcagtcagctataaaaacctagcaatttaatttcttagaaaaatgtagctggagttcaaactgtagtaacaaaggcaagtaaattaagttgtgggcaggtgtaattaagttaataggaatggcagggatgaatataaatcagaacaggactaacagtttgaaacattagatattcaaatgctcagagctgatgagccgagccactacgctaacaactctgcaaaccaaaggtttcacaaattgcacaagaacctggcctcgatcccattgtgttgctggcataagattagaagggcctgttggttcaattgttgctttggacagaggaggacaaacttgccacagtgaagaaatcatttttaaaaaccaccactgtcctttagtgcactaatttctctaataactaggtgtatattagaaataatgatatataagtgcagtatactccagtttcaacagaatggtgtcacttctgtaaaatgttgattttcagattgtcatactttctaaatacaaaaatttgtcacagcttccacatttacaagatattaaacattccataaaatatttgtagaaatatgaaaaaccaatttttgtagttgccttttgaaatgtatacaaaatatcccacatgggcaacatggtaaaacctcgtctctacaaaaaaaaaaaaaaaaatacaaaaagttagccaggcctggtggtgcacgcctgtggtcccagctactcgggaagctgaagtgagatcacctgtgcccaggaggtcgaagctgcagtgagctgtgattgcaccactgcactccagcctgggtgacagagtgagactttgtctcaaataaacaaaaagagacatatacaaaatatattagaaagttgggttaatatcctacaaacaaagtattacatagtttgcacaggattatgtgtgtaaaaagttttaaattcagtatagcttttatttctgcagaactaaaagtagtgcataaaaataaaagtgggatgagcatatctttttaatttgctatgcagtaaaaagtatctcagtcaacatataggaaaccagtgccatttctgtatcatttgacaccgaaggggtattgttttttgttttgttttgtttttcttttgaagaaagacttttatgtcttttattctattcttccgatttggggtttaaattacccccaataagtttgcagaatattctgattactactgcttaggtgatatatttcatatgagaactatctttacacaatgggaaaaaatatggtaaccacttcattcatcagagaagttgtgttttgtttacttgtattttgtttgctaaatgaaattggttatttagactcatggcatgctttttctcaaatggagatttaaaagtcatttccaatgtccttctaacttctggccaattcccagtaggctatagaataaacagttttcatataatagtcaaaaaagt

SEQ ID NO: 387326 - DNA, 170 bp, Homo sapiens
gcggccgcctactactactactactgctcgaattcaagcttctaacgatgtacggggacatgctttttctcaaatggagatttaaaagtcatttccaatgtccttctaacttctggccaattcccagtaggctatagaataaacagttttcatataatagtcaaaaaagt

SEQ ID NO: 387327 - DNA, 436 bp, Homo sapiens
atagtttttctgagaagtgtgggatagaacccttattttaaatggacagtttatcttaagacatccagttaaaataggaaaaaattaacatctagaatctaattaatgaggtttactctaagatttgtttaaaaatatgccttttaaaatctatttgtctctttgttttatttgtaattttagcgagatgaaatataattttgatagaccattcatttataacttttgtaattggcctctcatgcttttccttatctttttttgtgtcagctatgtgtaaatttgaaactaattatgacaccaaataaagaatccatttagggtgacctcattggaaaacagcatttttgcagatactcactctccttttagcaaatatggttaaattaccattttgaatacttctagaactatgaagaatggtggtgattcatga

SEQ ID NO: 387328 - DNA, 435 bp, Homo sapiens
ccataatataacactaacgaaaatgaacacattcgctacaatcaacaagtaataaataatggactgggattactattaggaaaaaaaaggcacacaaagactaggagttttatatatattaattcaggtaagtactattatgctactactgtcattttgcaaatgagaaaactgcaacacaaagaagttaaataacttgttcaagattatacggctatttaagtatgaagctggcattcaagcttaagcacgcggttagtcccagaatcccctatcataactatcatgctatacttgttcatcttaaaaatttttggtttgttcttgatttttgagatagagtctcgctccgtcacccaggctggataagtatgtagttagttacgagcattaccatattgctttaatttctcctgtatctgtcgattacttccc

SEQ ID NO: 387329 - DNA, 458 bp, Homo sapiens
ccataatataacactaacgaaaatgaacacattcgctacaatcaacaagtaataaataatggactgggattactattaggaaaaaaaaggcacacaaagactaggagttttatatatattaattcaggtaatcctcacaacaatatcaaggtaagtactattatgctactactgtcattttgcaaatgagaaaactgcaacacaaagaagttaaataacttgttcaagattatacggctatttaagtatgaagctggcattcaagcttaagcacgcggttagtcccagaatcccctatcataactatcatgctatacttgttcatcttaaaaatttttggtttgttcttgatttttgagatagagtctcgctccgtcacccaggctggataagtatgtagttagttacgagcattaccatattgctttaatttctcctgtatctgtcgattacttccc

SEQ ID NO: 387330 - DNA, 360 bp, Homo sapiens
acgtgaacccagagtcttcctgatggacggggtgcttggatggagttcaagagggggagtgacttagttatttctgaattttggaaagatcatttgcagggcgaatagacagggaggaagccatccaggggcagggagacgggccagggtccactgcagtagccccgggcagatatgagacaggaaggagggctgggcacagggccgaaacgtgtgtgtaacagggcttgctcagagaggtgcggggctgggaccttgctccgactgccctttgcagggcgtgtactgatttgagggcagccagactcattcagatgctagctgaggccaggacaatggctggccccagagagggctgca

SEQ ID NO: 387331 - DNA, 98 bp, Homo sapiens
gagctgggggactcggccctttatctttgcgccagcagctggcagcgggagctacaatgagcagttcttcgggccagggacacggctcaccgtgcata

SEQ ID NO: 387332 - DNA, 94 bp, Homo sapiens
gagctgggggactcggccctttatctttgcgccagcagctggcagcgggaacactgaagctttctttggacaaggcaccagactcacagttgta

SEQ ID NO: 387333 - DNA, 107 bp, Homo sapiens
  misc_feature (38)..(38): n is a, c, g, or t
gctgctccctcccagacatctgtgtacttctgtgccancagtgagggcgagcggccacagatacgcagtattttggcccaggcacccggctgacagtgctcgaggac

SEQ ID NO: 387334 - DNA, 106 bp, Homo sapiens
accagctcccagacatctgtgtacttctgtgccatcagtgacgggacagtggaactatggctacaccttcggttcggggaccaggttaaccgttgtagaggacctg

SEQ ID NO: 387335 - DNA, 99 bp, Homo sapiens
gagctgggggactcggccctttatctttgcgccagcagctggcagcgcacagatacgcagtattttggcccaggcacccggctgacagtgctcgaggac

SEQ ID NO: 387336 - DNA, 92 bp, Homo sapiens
gagctgggggactcggccctttatctttgcgccagcagctggcagcgataatgaaaaactgttttttggcagtggaacccagctctctgtct

SEQ ID NO: 387337 - DNA, 129 bp, Homo sapiens
  misc_feature (24)..(24): n is a, c, g, or t
  misc_feature (44)..(44): n is a, c, g, or t
  misc_feature (55)..(55): n is a, c, g, or t
gagcttcgtgactctgctgtgtanttctgtgccagcagctgaancgggagggtgnttcacccctccactttgggaacgggaccaggctcactgtgacagaggacctgaacaaggtgttcccacccgagg

SEQ ID NO: 387338 - DNA, 86 bp, Homo sapiens
cgggactcagccatgtatcgctgtgccagcagcttaagggctactacgagcagtacttcgggccgggcaccaggctcacggtcaca

SEQ ID NO: 387339 - DNA, 97 bp, Homo sapiens
gagctgggggactcggccctttatctttgcgccagcagctggcagcgagggctactacgagcagtacttcgggccgggcaccaggctcacggtcaca

SEQ ID NO: 387340 - DNA, 108 bp, Homo sapiens
accagctcccagacatctgtgtacttctgtgccatcagtgacgggacagtgggttgcaatcagccccagcattttggtgatgggactcgactctccatcctagaggac

SEQ ID NO: 387341 - DNA, 105 bp, Homo sapiens
  misc_feature (103)..(103): n is a, c, g, or t
  misc_feature (105)..(105): n is a, c, g, or t
gagcttcgtgactctgctgtgtatttctgtgccagcagccagagcacaggcgaacaccggggagctgttttttggagaaggctctaggctgaccgtactgggnan

SEQ ID NO: 387342 - DNA, 98 bp, Homo sapiens
gagcttcgtgactctgctgtgtatttctgtgccagcagccagagcacacagatacgcagtattttggcccaggcacccggctgacagtgctcgaggac

SEQ ID NO: 387343 - DNA, 102 bp, Homo sapiens
cctgcagaactggaggattctggagtttatttctgtgccagcagcggttgcaatcagccccagcattttggtgatgggactcgactctccatcctagaggac

SEQ ID NO: 387344 - DNA, 104 bp, Homo sapiens
gagctgggggactcggccctttatctttgcgccagcagctggcagcgggttgcaatcagccccagcattttggtgatgggactcgactctccatcctagaggac

SEQ ID NO: 387345 - DNA, 107 bp, Homo sapiens
  misc_feature (7)..(7): n is a, c, g, or t
gctgctncctcccagacatctgtgtacttctgtgccataagccccgggacaggcctccccgcataatgaaaaactgttttttggcagtggaacccagctctctgtct

SEQ ID NO: 387346 - DNA, 104 bp, Homo sapiens
  misc_feature (102)..(102): n is a, c, g, or t
  misc_feature (104)..(104): n is a, c, g, or t
cctgcagaactggaggattctggagtttatttctgtgccagcagccaggcgaacaccggggagctgttttttggagaaggctctaggctgaccgtactgggnan

SEQ ID NO: 387347 - DNA, 101 bp, Homo sapiens
gagcttcgtgactctgctgtgtatttctgtgccagcagccaagcagcgggggagctacaatgagcagttcttcgggccagggacacggctcaccgtgcata

SEQ ID NO: 387348 - DNA, 106 bp, Homo sapiens
  misc_feature (104)..(104): n is a, c, g, or t
  misc_feature (106)..(106): n is a, c, g, or t
gagctgggggactcggccctttatctttgcgccagcagctggcagcgcaggcgaacaccggggagctgttttttggagaaggctctaggctgaccgtactgggnan

SEQ ID NO: 387349 - DNA, 130 bp, Homo sapiens
  misc_feature (7)..(7): n is a, c, g, or t
  misc_feature (128)..(128): n is a, c, g, or t
  misc_feature (130)..(130): n is a, c, g, or t
gctgctncctcccagacatctgtgtacttctgtgccatcagtgaggctgcaatgctagcgggagtttctggcaggcgaacaccggggagctgttttttggagaaggctctaggctgaccgtactgggnan

SEQ ID NO: 387350 - DNA, 115 bp, Homo sapiens
caaaagaacccgacagctttctatctctgtgccagtacccccccacggggtgagggtggcgaactatggctacaccttcggttcggggaccaggttaaccgttgtagaggacctg

SEQ ID NO: 387351 - DNA, 96 bp, Homo sapiens
ccagaagactcagccctgtatctctgcgccagcagccaagacagcggagctacaatgagcagttcttcgggccagggacacggctcaccgtgcata

SEQ ID NO: 387352 - DNA, 92 bp, Homo sapiens
ccagaagactcagccctgtatctctgcgccagcagccaagacagcggaacactgaagctttctttggacaaggcaccagactcacagttgta

SEQ ID NO: 387353 - DNA, 99 bp, Homo sapiens
  misc_feature (96)..(97): n is a, c, g, or t
acatggggactcagctttgtatttctgtgccagcatcgtaggaatgtttcgggagacccagtacttcgggccaggcacgcggctcctggtgctcgnnga

SEQ ID NO: 387354 - DNA, 92 bp, Homo sapiens
  misc_feature (31)..(31): n is a, c, g, or t
  misc_feature (36)..(40): n is a, c, g, or t
  misc_feature (42)..(42): n is a, c, g, or t
  misc_feature (45)..(46): n is a, c, g, or t
  misc_feature (48)..(48): n is a, c, g, or t
gggcgactcggctgtgtatctctgtgccagnagctnnnnncncgnngngcctggaaacaccatatattttggagagggaagttggctcactg

SEQ ID NO: 387355 - DNA, 423 bp, Homo sapiens
agcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagccgaagcacagccctgcatgagcatcagccttctgtgcaataacattcctgccccactcaggaagtgacggtgaggggagggctgccagccagaggggctcaggccctggagagtggacaggcctttcccaggcactctctggtgcttctgtatgtgatctggtttactgctcactgaagctgtttcactcgaatagctccttgaccaactgtaacccagaatcataaagataaaggcattcttagaaatata

SEQ ID NO: 387356 - DNA, 105 bp, Homo sapiens
cctgcagaactggaggattctggagtttatttctgtgccagcagcttagggacatcagagacgcagtacttcgggccaggcacccggctcacagtgctcgaggac

SEQ ID NO: 387357 - DNA, 100 bp, Homo sapiens
gagcttcgtgactctgctgtgtatttctgtgccagcagccaagcagcgggagggctactacgagcagtacttcgggccgggcaccaggctcacggtcaca

SEQ ID NO: 387358 - DNA, 100 bp, Homo sapiens
cctgcagaactggaggattctggagtttatttctgtgccagcagcgaactatggctacaccttcggttcggggaccaggttaaccgttgtagaggacctg

SEQ ID NO: 387359 - DNA, 97 bp, Homo sapiens
gagcttcgtgactctgctgtgtatttctgtgccagcagccaagcagcgggggaacactgaagctttctttggacaaggcaccagactcacagttgta

SEQ ID NO: 387360 - DNA, 103 bp, Homo sapiens
gagcttcgtgactctgctgtgtatttctgtgccagcagccagagcaggttgcaatcagccccagcattttggtgatgggactcgactctccatcctagaggac

SEQ ID NO: 387361 - DNA, 101 bp, Homo sapiens
gagcttcgtgactctgctgtgtatttctgtgccagcagccagagcagaactatggctacaccttcggttcggggaccaggttaaccgttgtagaggacctg

SEQ ID NO: 387362 - DNA, 120 bp, Homo sapiens
  misc_feature (61)..(61): n is a, c, g, or t
gagctgggggactcggccctttatctttgcgccagcagctggcagcgcccggggagggggnacacttcacccctccactttgggaacgggaccaggctcactgtgacagaggacctgaac

SEQ ID NO: 387363 - DNA, 102 bp, Homo sapiens
accagctcccagacatctgtgtacttctgtgccatcagtgacgggacagtgggagctacaatgagcagttcttcgggccagggacacggctcaccgtgcata

SEQ ID NO: 387364 - DNA, 105 bp, Homo sapiens
  misc_feature (38)..(38): n is a, c, g, or t
gctgctccctcccagacatctgtgtacttctgtgccancagtgagggcgagcggcagggctactacgagcagtacttcgggccgggcaccaggctcacggtcaca

SEQ ID NO: 387365 - DNA, 97 bp, Homo sapiens
cctgcagaactggaggattctggagtttatttctgtgccagcagccacagatacgcagtattttggcccaggcacccggctgacagtgctcgaggac

SEQ ID NO: 387366 - DNA, 233 bp, Homo sapiens
agcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagccgaagcacagcccttctggggccaacgtcctgactttcggggccggcagcaggctgaccgtg

SEQ ID NO: 387367 - DNA, 116 bp, Homo sapiens
  misc_feature (7)..(7): n is a, c, g, or t
gctgctncctcccagacatctgtgtacttctgtgccagcagttaccgtacctctggggaaactggtagggctactacgagcagtacttcgggccgggcaccaggctcacggtcaca

SEQ ID NO: 387368 - DNA, 96 bp, Homo sapiens
gagcttcgtgactctgctgtgtatttctgtgccagcagccagagcaagggctactacgagcagtacttcgggccgggcaccaggctcacggtcaca

SEQ ID NO: 387369 - DNA, 98 bp, Homo sapiens
accagctcccagacatctgtgtacttctgtgccatcagtgacgggacagtgggaacactgaagctttctttggacaaggcaccagactcacagttgta

SEQ ID NO: 387370 - DNA, 95 bp, Homo sapiens
cccagggactcagctgtgtatttttgtgctagtctcggaagagggccaggaacactgaagctttctttggacaaggcaccagactcacagttgta

SEQ ID NO: 387371 - DNA, 95 bp, Homo sapiens
  misc_feature (37)..(37): n is a, c, g, or t
  misc_feature (39)..(39): n is a, c, g, or t
  misc_feature (41)..(42): n is a, c, g, or t
cagggggacttggctgtgtatctctgtgccagcagcncngnnacagcaggaacactgaagctttctttggacaaggcaccagactcacagttgta

SEQ ID NO: 387372 - DNA, 95 bp, Homo sapiens
gggggactcggccctttatctttgcgccagcagcgacaggactagattggtcggagagacccagtacttcggcgccgggacccggctctcagtgc

SEQ ID NO: 387373 - DNA, 127 bp, Homo sapiens
  misc_feature (53)..(53): n is a, c, g, or t
cgggactcagccatgtatcgctgtgccagcagcctatcagggtccggtctganttcacccctccactttgggaacgggaccaggctcactgtgacagaggacctgaacaaggtgttcccacccgagg

SEQ ID NO: 387374 - DNA, 522 bp, Homo sapiens
agttggcagttaacagtcgggagggtaaaacacaatcatggtgccataaaagagtgaaggagccggcattacacacagacagcccgcagaagggcagcaacgttttggagctccttttagttctctttattgatatattttaattgaacccagattttttttttcctgtctagcccttggagacaagctctgccagagctcgtatagcagagagaaggtcttgagattagtgatactcagcgtttctgacactggagacctgcataagaatttaacaaactgggaagcagttttcatgacaacccttttcattgcatagatgttaccaagagtttgggggtgtttttaagaaaagccattaggctggaagtcagacacacctggatttgagatccgctctgctacttcgtacttgcgtggttttgaggaatcatttggcctcttttcaggttttagatccttcacctgtaaaatgaggatggttgtgagaaagggaaattgctctgtaaacagtgaagcact

SEQ ID NO: 387375 - DNA, 387 bp, Homo sapiens
gagaacccccctcaagagaacttgaagaaggagcagaatgggaccagtgagttcattttagtgaaggctgatgcagcataacccccgggccttcctccagcagcctctccaggcctccttttctttctgaaaggtcttagggaggtaggattaaagctccagacagcgttgtaagaaaatatgtcatgtgccttgagaaaggtgattgtgaaaatgaacacttaggaagaggtgtcaccattaccgtctgagcctggccccaggaggtacacatccgcattctcacgactttgtgttttcatgagcacagcctgtgtcctgggtggatctgggagcatcaggagccagcccttccttcctctctctccctcctccctccctctgatt

SEQ ID NO: 387376 - DNA, 748 bp, Homo sapiens
tgtaaatgaatactgacaaaataatagtataacatcagagagatttttgtttgtttgttgagacggagtctcgctctgtcaccaggctggaacgcagtggcacaatctcagctcaccacaacctctgactccctggttcaagcaattctcctgcctcagcctcctgtgtagctggtattctactggtattagctgggtgtggaggcacgcgccaccacacccagctaatttttgtattttagtttcaccatgttggccaggattgtcttgatctcctgaccttgtgatcggcccacctcggcctcccaaagtactgagattacagacgtgagccaccacgcccagcctagagaggtttttttaaacaaaacgaatatgtaactgatatcttgtattttaaatttaagagggcatatgaaattgaatgcattctgtgagaggagagtcagagtattgataaatttggacttattaaaattcctggagtaatgacttaacctacaaactattaaagagaaaattggaatagtaatacatcaatccaacataaagaaaggagagaaaaaggaaacatgcaacaaaaagaaaacaaattaaaatgccaggagctaatgcctgtaatcccagcactttgggaggcagaggcgggaggatcgtttgaacccaggagttcaaggccagcctgggcaacatagggagaccctgtttttaaaaagtaataaataaggctccgaagcagggaatgggg

SEQ ID NO: 387377 - DNA, 548 bp, Homo sapiens
tgatgaatatttactttgatgaaataaatgacaaacagatgtcatttatttcaacaaagtaacatgtttgtcctttggacctcgtttctatatatactttcaccttaggtaatttcatcccatccagcagaatgaagttaccatctctatgatgatggttcccaaatttatgtttatcctgaaactattctttgaactccaaacacacatgtacaactgtttgtacaacatttcaactttgtcatctcacaagaatctcaaacatgactcgatttttttccccctcaaaaactatactactagttcttgttattctgcagtttattaaatggcactaccatccaaccaccgcaagccttgacatcatcatcctttgactgttctgttttatccctaccttcaagatctccctcattagtccaagccaccatcatcttttgtctggacaattgcattcttttctgaagagttctctcatttccgctcttactctcctatggttttcacagagcagccagattgatctcttaaaatcagatcacactacc

SEQ ID NO: 387378 - DNA, 397 bp, Homo sapiens
tccaaaaaaatgtgattcctcgtattggtaaaatgtgttgtcattccctgatgaaatagaaagctgtagtttctaggtaaatgtggaaaataattcttactaaagaaatgaatataaaaatatgcggactgtataacaatgttactttaatctatttagttatgtagaagagttctcaaaacaagagctttgaaatgcagatgtgctaataaatattttctctccttaagcaggaactcaatttgtaaaataattattcagaattcatggtagccaaaaatcccaaatttggtagtgctataatgtcttaaattttttaagtaaagtaggctttttagatcttttaaaaatctagaatatcatttaatttgttagtatggcaaaatacaggaactaa

SEQ ID NO: 387379 - DNA, 1933 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgagggctgaggacctgaggagtccgctgtggggatggagagggacaggggggttttcgggccaggaacttgtaaaactctgctcgaaaaaagacaaagacaatgcggcgacattaaagtgctgggacagaggtgcagggaacacctaatcttcccgtcgtaacacggccgctcggtctctagatgtttctgtttaaatcgtcgtagccctagtctagagcgccggctttggggtcaggcccgggttcgagtcccagccttcgccgctgcgtcgagtgacttaacctctcctagcttcagtcacctgcagattgagagtctactactttttactgctcagaacttcctattccttagctgcaaaataggcagaaataagcataaaatcctgtctcaaagaattgagaaggttaaataagagaacccggtaaaaacatcgatcacacagttgttgtagacatacaacaaaatttagttccctttaaaacacgtagtttgccaccatcttaatgataacagcagccaacatttagataggacttatgtggcagatgctactgtaagtgcttttatgtattacatagaataactcatttaatagtcacgatatccttatgaggtaagtactattatccctattttatatatgaggaaatcgagggctggaggattcaaataacttggcagttacacagctgtggaaacaagattcagactcacaaaactgatgccagagtccattcttcttttaaacattttacctagtagatgtatgactttgaacaaaccacttttctgaaatttaggttcccacctcacaaataataactcacagggtatggattaagtgaaaatgaaagaccttagcacactgtaagtcattctacaaaggcagtattatcttgtacttgttggtaggagatatgactactaagaaatgcttatatgattctcaaatagcaaaattaaaagtttaatgataataacctcgtagaagtaagtgtaaaataaagcaaactgattctcctgtattgtgattaggacactccttttggagagcagctttgcagtttgtatcaagggttattaaattgctaataacctttcaccaaataattttctttttaatcctaaatataaaaaggctgttttcagtagatagaaaggcttattccaggtttgttttttttaattgtgaaaaatatgaagcaaaccaagaccattattatattacttccactgaaggaaatattatacaaccattaaaaatttatgaatatgaaaaagatttaaaagtagaaaacacaggatttaaaattgcaaatatctaggtattatgactaagtaaaaaatgcata

SEQ ID NO: 387380 - DNA, 752 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagctaagtacttgaagacgtttacaacttcagatttcaaggaatttttcaggtctttgggctggatgacatgtcgtctaccccagaaaattaggtaggcctctaccatcacaagctctgaggaac

SEQ ID NO: 387381 - DNA, 4091 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387382 - DNA, 4624 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387383 - DNA, 4354 bp, Homo sapiens
gttcatagactaatactaggttctgtaagagaaaacaatgaagtacagccctgcttagagaaacttgtggtttagtcagaaaggcaggaggatgaaagataagcaatataaggcagtgtgtcagtggcatatgatttctatagacaatatgtgctctagggtggtgaagagtagtcactagactggaatgattggattggaaaaggcttcatggaagaagaaaactcagatgagccttggtgagtgggtagaattggattggtaggaatggttcatgaacaatgttattggaaggtgagaaaagcttgttgggtaactaaattggcctgcctgaaatgaaaaattggagttgggagtgatggggcgatagttggaaaagtagcttgtggtcaagctttggaaactttaaatgccaggccaagattttgtttgtttggttggttttgttttgttttgtttttgaggacccaaagcatcagaattgtacaaactattctctttcctattgcattttcccttgagaacatgaactgacaaggaacaaggtgaaggagtttgactggactttagggataatataactcccttaaaagaagtgttaaaatgaaggagagattttacaaatgcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387384 - DNA, 4431 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387385 - DNA, 4888 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacagctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387386 - DNA, 3570 bp, Homo sapiens
gtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387387 - DNA, 4315 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctccta

SEQ ID NO: 387388 - DNA, 4573 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaagaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387389 - DNA, 2858 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagcaccactggctaaggatggcgacaccacaccacggttgctgaagtactctacgtctga

SEQ ID NO: 387390 - DNA, 2213 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattggtacgtatttagacagtagttatg

SEQ ID NO: 387391 - DNA, 2122 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaatgtaggtaaaagaactttaaggattgataaattatttgtggctctggaaatgttgataaagaattgagcttttgtaattactttgaggggataaatttaaaatattgtagaaacataagaaaataaaagatgctgtcacttcccaataatata

SEQ ID NO: 387392 - DNA, 1099 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatgtaagccttttttctcttagttatttaaagataatccttaattgtgggtattttgatcaattgtcaggattatacagttgattttcattttaataatcagtattagttaggtttatgtgtgcttatgcctttctgtattcagcttctaatcactgagtagtccactttgcttgctatcattttctcaagaagaaaaatagaaa

SEQ ID NO: 387393 - DNA, 887 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccagactttttaaaactgtggacttaaatgttctgcaaagtcttacacaaaagcccaatacagtacatgaactacggaaaagcagaactgctctgaacaaggaagaggtgggagatctgagtcctggccccagcacccacttcaacttcagtcacctccttggaatctggggttctgcagcttgaaataatcagtttggattttaaacttatttgtaacataataataatcctaggaactttaaaataatattttgtactaaattttagaattattataataagtgatctaataaaacagtcttttcctgaaagatg

SEQ ID NO: 387394 - DNA, 4147 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387395 - DNA, 3872 bp, Homo sapiens
aaatatttgtaagaatattaataagcttgttttccaggacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacagctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387396 - DNA, 4501 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387397 - DNA, 4428 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgctgaaactgtacacgggcttgatggttgtgcttctttgctgagggacattttgagaaatgaagattcagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387398 - DNA, 4621 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacagctgaaactgtacacgggcttgatggttgtgcttctttgctgagggacattttgagaaatgaagattcagaacatgaactgacaaggaacaaggtgaaggagtttgactggactttagggataatataactcccttaaaagaagtgttaaaatgaaggagagattttacaaatgcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387399 - DNA, 4405 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaataattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaatgttgtgttatcactaatactttgtacaggtcacctgcctactctaattgtccttagtacttggacaggctttatcattaaagagtgttctcctaatcccagaacctcctcgtgttttttgtttttttggtggttttttttttttttttaggtgttagtgctacagcgtttgaaggagccagctgtagtctctttgatatgttcagattttccagatagagatttaagtctaaaaatttattaagtgaattctaaactatttcacacaagagtccattagcatctttaattttatttagtattcatgaattaatttattggcatcttatttggaggtaataggccacaactctttaacaaataagttcagaaataaaaaataataaaaaaggaaaaaaaaaatg

SEQ ID NO: 387400 - DNA, 3989 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagtggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaattcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagcggtggttggctttagtttccctctggagcagctat

SEQ ID NO: 387401 - DNA, 2635 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagaggattcagaaattcagaggttgattacagaaatggaggcatgtatatctgtacttccaacagtaagtggaaacacagatattcaagttgagatagcactggccatgcaaccattaagaagtgagaatgctcagttacgaaggcagttgagaattttgaaccagcaactcagagaacaacagaaaactcaaaaaccatctggtgctgtggattgcaaccttgaattgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattgaattggaggaagccctagtcaatgtgaaaagctcccagtttaagttagaaactgctgaaaaggaaaaccagatattggggataacattacgtcagcgtgatgctgaggtgactcgactaagagaattaaccagactttttaaaactgtggacttaaatgttctgcaaagtcttacacaaaagcccaatacagtacatgaactacggaaaagcagaactgctctgaacaaggaagaggtgggagatctgagtcctggccccagcacccacttcaacttcagtcacctccttggaatctggggttctgcagcttgaaataatcagtttggattttaaacttatttgtaacataataataatcctaggaactttaaaataatattttgtactaaattttagaattattataataagtgatctaataaaacagtcttttcctgaaagatg

SEQ ID NO: 387402 - DNA, 2126 bp, Homo sapiens
aacaaccccgaggtcttatttttatagaatatcaagaacaaaatcttccaaaaggcacacgatgccaaactaaaaataaagagcgaaaacccaaaaagtcgcgctcaattccttctgaaacctattcgcctcctacccctgtcccatcctctggcgctggcgggtcctcgtccccgttttccccaccgcaagtcctggaacctccgcttaactcttttctcggcggctccgccccggccccgccccagccatgccttggccccgccccgttcgccgtttattggcttctcccaacccctgccggtgggtgacaagccgggaagcttggaggggtctattgcgtacgcccaaggcgctgggcctggagcaggagaaagggagtggaggcgcgtcggagactatgaagcgcggcattcggcgggatcctttccggaagcggaagctcggcgggcgggccaagaaggtccgggagcccacggcggttaattctttttaccgtgaggcttcacttccctcggtctgggcttctctgaggcggcgagagatggtcaggtctggagctcgaccgggccaggtgttatcttcaggaaggcacactggacctgctaaattaacaaatggaaagaaagcgacctatttaagaaaaataccacgttttaatgcagattctggctattccatccattctgattcagaaagtcaggctgaaactgtacacgggcttgatggttgtgcttctttgctgagggacattttgagaaatgaagattcaggttcagaaacagcatatttagaaaacagatctaattctagacctttagaaagcaaaagatacggatcaaaaaagaaaagacatgaaaaacatactattcctttggtagtccagaaagaaacatcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctgaatctcaggcaactcctcattctagttatggcttatgtacctccaccccagtctggtcacttcagcggccaccctgccctccaaaggttcattctgaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaagggtagatgggacttataactttctgtagtatggtgttatactaaatagcaatgtcatgttatttagctatcatttaaatggagtttgtggtattttccatagaactgtgttttgagctaataagaaaatgagttctacttattgtattattttttaagttttgatcccttctttcctgtggatttaaaatgcgtttgagaatatcaaacattcagtcttttgcttgcaagtgtgtatttattctgcttgataatagaccttgaaaagagtcaaccaaagagaatttggacagataaaaattttaattagagaatgcctataaatgattaactccctgagtagactgattattcttcctgttttaaaaagatgcagagaatt

SEQ ID NO: 387403 - DNA, 750 bp, Homo sapiens
ctgaatggatgtcatgactatatatctaataattacttaggaaatcctctcaatctctgggcatggggtattaggctatgaaaaccagaattttccattttaatcataacaactctgaacatttttatgctaatggtgaaagcagaaactttgttcttgtcctcaaatcaaatttaagctttcctgttgattacacatatccttgacgagtaagattcactctctttcacctgcctggttattgatcagctcatgagcagatggaagatctaagcataaatcactcatgaagatgatgaataagctgaaagtttattcatatgtataccctttcttatccagtgatagtagaagcttcatatttaagaaggggattaatgacataatttattattgtttcttgttcttttcgttaaagggaataaacaatataagtgaataattaattgaattttgtaggaagggttcagaaaagacctgccagatacagacaggaacccttgtcattaaacccaaggccagcagacattgcacgggtgtgtgttagaagcaaaggcaaagggctctgggaaagagagtaagaaagtgttccttttagatctgagaaatagtaagctttaagaggctggctttattgatttatttattgagacaaggcctcactccatcacccaggctacagttgcagtgagctgagattgcgccactgcactccagcctgggtgacagagcaagacttcctctcaggaa

SEQ ID NO: 387404 - DNA, 344 bp, Homo sapiens
ctaaaaacctcagaagtttgcctaacagccctcggaaggaacctcagtttataggaggtctgtgtacctggaggagggtgggctgggatgagagggagtcagacctctgcaatttccagtattttatttgaagacagtccagaggcttaaagggtctgaaggatgcattattactgggaatccagggtctggtgaaagctagaaagctgttatctaagcaaaggggagtttaagattagaaactgaatttcccagccttgcctgtgctctagaaacaatggggctgggtgcggtggctcactcctgtaatccgagaactttgggaggtcgaggcgggcagatct

SEQ ID NO: 387405 - DNA, 385 bp, Homo sapiens
tggaaacggagtctcgctctttcgcccaggctggagtgcaaatctcacctcactgcaacctccacctccctggttcaagcgattctcctgcctcaatctcctgagtagctgggactataggtgcatgccaccacgcccagctaattttttggtatttttagtagaaatggggtttcaccatgctgggccaggatggtctcaatctcctgacctcgtgatcctcctgcctcggtctcccaaagtgctggaattacaggcatgagccactgcgcccagcccatatacggctaatttaaaaaaaatttttttttgtagagatgaggttgttgcctaggctggtgtcaaactcctggactcaagcaatcctcctgcctcggcctttcaa

SEQ ID NO: 387406 - DNA, 287 bp, Homo sapiens
cttgccccttcctccatctttcaagtgcatcatcccaatctttacttgtattcatcacaccgccttttcatctgtgagaagtcaagttctagtgatgattcagaggtgacttttaagcagataagagcaaagggacacaagcaggaacctgccagacatagtggtgtgtacatgtagtcccagctacttgggaggctgagaaggaaggattgcatgagcccaggggttcaagtccagcctcagcaacatagaccccatctctaaaataaatgaataaataaataaat

SEQ ID NO: 387407 - DNA, 412 bp, Homo sapiens
ggttggagtgtagtggaatgatctcagctcactgcaacctcctcctcccaggttcaagtgattctcctgccttgcctcctgaatagctgagattacaggcatgcaccaccacgcccagctaatttttgtatttttcgtagcgagagagtgggtttcactatgttggccaggctgatgtcaaacttctgaccttgagtgatccacctgcctcttcctcccaaagtgctgggattagaggcctgagccaccgcgcccagccggtggtttctttctaggtagacggtgatatcatcttcgaattatgacaattttctctcatcttccaatccttacatcttttctttatttttctttccttagggcattgaccaggagaatgcagttctgtgttaaaccacaggggattactgag

SEQ ID NO: 387408 - DNA, 404 bp, Homo sapiens
aacctgtagtcccagctacttgggaggctgaggcaggagaatcacttgaacctgggagatggaggttgtagtgaaccgagatcataccattgtactccagcagcctgggtgacagagtgagacagtgtctaaaaaaataaataaataaaagaaaagaaaagaaaaaaagaagaaagagagagagaaaaaaattatatgcaaagtttcagctgcatgggggggtcagtgtccctaatccttacattgttcagggtcaactatatagaggacacatgaggattctgcaggtgtgacaagatattctcctatgagaagaaggaagaggaaagactagaaaagggaggatgaatttagcaaaaaccaacttagtccactttataagtttgcataaggctcgccctgga

SEQ ID NO: 387409 - DNA, 891 bp, Homo sapiens
gcctgctgctgactctatcacttggagcaataatgtggggttatggtggtggaatcttgtatatttttgtcaaaaataaaaccttgagttaaggggatagatatagatggaaaaatacacaaataaatacggtatgaaaacacatggaaatgtgtctttgtcaaatctgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttt

SEQ ID NO: 387410 - DNA, 462 bp, Homo sapiens
ccagtcgcggctcatccacccggccgagggcctgcccaccttcgacactggaggagggggtactggagcggcccctaccccacgctgcttccagacgccgggctgagtgggaacctctctgacctctgccgtgtactcattgcacctttcaaccctggccacttttcccaagtacataaagactcgggggaaaaagaacacccgcggtggtccatgaaggccatgtgaaggcatggactgtgacgttttttgctctgcatggaatccctagcgcctaggacagtgcctactacgttgatagatgagtgaatataaacgtcctttaaaaaaattaagtgatgatggtcgcttaacattgtgaatgtaattaataccactcacttgtatgcatagaaatagttaaactgtcgaattcatgttttatataccttactgcaataaaaacatttttaaagttaaaaa

SEQ ID NO: 387411 - DNA, 587 bp, Homo sapiens
aacctcaaaacatttactcaatccccaatacacctaaaaagtcccagaagtgctatgtccatatcactatgaaaagtaaacctaatagaatgagttcaagagttgcctgcaacccgtctctttcaactctacccaagctgacggtatatggttatagttatagcaccatgttattagtaataaattacttagatttactctttgttccctcaatgggggtacaatactaatttaaaatacattcaggttcatttgtttcagtggattaggattctccccatttccgtccttattttgaatactgaaaaaaacacactatgaaaagccaaaactatattttttaaaaaaaggtttactttgaagtgtcattgcctcccataaacctctggccccattacctctcactaccccttctttttgtaaagtcaagcatatatatgtatgtgttattttcccttttttcttacataaaagatagcacactatatattcttgtttatactaaccagcacaatccagattgaagaaagctcttcccaaagccttttataagatacaatatcctgatatcaaaaccagacaaagag

SEQ ID NO: 387412 - DNA, 586 bp, Homo sapiens
ccagtctaggtgacagagcgagactccatctcaacaacaacaacaacaaaagacaaccaaaaccaaaaaaaaacaaaaaacaaaaaaccaatcctatactcattgctcccagtccactaaagcagaaagaaaactggactgggcgttaggtgacatgaaccccagtcccagctccgcaggcctccaaggctctctggcctctgtttcctttcctataaaatggggtaacatagtggctggcctggttatttcaagaagagagtgtgagattgcagagagagggtgggctttctggtgtcagaacaagtttctaatgaggaaaaatgacttgccttcttggagcctcactgtcttcatctgttaagttacaggggaaaagaaaatatgggatatgtaagtgtgcaatgcctgtcagctgccagaagtgcagcaaatgttaaatcccttctctgctcaaaaggctatgatggaaattcaaaagccccttctcagtaaggccctctggacacccaatctgaaatgtcgggcccctcccccttttctctttattgcggatcactgtctaacatttgacttctttatctgg

SEQ ID NO: 387413 - DNA, 325 bp, Homo sapiens
cgacatggtggccaggctggtctcaaactcttggcctcaagtgatctgcctgcctcagcctcccaaagttctgggattacaggtgtgagtcactgtgcccggcctcttggtgtcttttgctgtacctggaccaatccaccccgccttctcttggcctatggcagccccgggacatcacaggccacagacttatcacaggcaattatgccaactctcctctaacagaaagaaacagcagcacctccaacccaaagctggtggcccagagagtgcagtaggctgctgcctgctgaggctgtgatcctgtggccagcgaggcttggca

SEQ ID NO: 387414 - DNA, 302 bp, Homo sapiens
ggtttttataaaaatcagaatttttcaaatgcattggtcattttcagatgcattggtcacatttcattattccatatcaaaaaactgcatttgttaatgtcacacaaatctcattggaaaggtcttcaagtattgtgaagttgtccaggtcacaaagatgaatgctagtttttcaaaattctactttttacttgaatgctcaaatcttataattggtaacccggtcagtttttctttagttgataggcttactgcttttatgtgttgagaatacttgtctgtgaaacatccaaatctggaag

SEQ ID NO: 387415 - DNA, 694 bp, Homo sapiens
tgactagttctttgaaacctcttttatactatagggggatgccgtcgggcattgtgagatgttatctacctgggcatgggggtacacccctctagtctcaactatttgggaggttgaggcaggaagatcgcttgagcccaggaatgagtccagcctgggcaatataatgagacactatctccaaggaaaaataatgtctgactgctttttgtaatgtgggagtcagcatttagaatctgtatggagcccaagaaaaaaaatctctaataacaaggataaaagtttatgtaaagtgtccatgttgaatccaaattagttattcatgtttggcaattggggcattttttccttaagttcttgatagataactaatcagcagactttacaaatatctcatgaaagacgggaaatactagtatttgtatacttgttatagtttgaaaagaatcagtgtatagagtgagatttttctatttttggtacatcataattttgttgtttttagggagtaaaggatatctgttttgtttttgctgtgtccttgctgcacacccaatttatagaaaaggagccaggtgcagctgctcatgcttgtaattccagcactttgggagaccagggtgggtggagctcttgaacccagagaaaccagcctgggcaagatggtgaaaccccttctctaccaaaaaaaaaa

SEQ ID NO: 387416 - DNA, 223 bp, Homo sapiens
cttctcacaagcctgtctgaaccccagttctgtggtctgtggtgtactgaagaggggacaggatacaagctggctgagctttgctctagctgccccgcccgggcaaagctgcaggaacacccagctggcctgactccgcctggctccttctcaccacaagcccttctctgccctttcctcactcagtcactgctcctgaccttgggcctatgtatcaaacaag

SEQ ID NO: 387417 - DNA, 355 bp, Homo sapiens
ccccagggcctccatttcttcatctgctttcagagacaaggatgtccccaaactgtgtggcccaagcagccggcaggacttggcaaacccagagggctgaggtcgggcctcggtgggatttgtagggagtgttgggagctctggctcaaggctggccacgttggcccctcatgcgctgacaggtgtgtctgactcgggccacacagcactggccagggctgcagagggagctcagagggccagcacagcgactggtggaggaagcctggtatgggagcatcgctaggcgaggctgtcagcacttggtgtctgtgcgttctgtctttaataaagtctcatggtgacccagctctgg

SEQ ID NO: 387418 - DNA, 231 bp, Homo sapiens
agcctcctctgacatccccagtccctaaatgagaacgtttcaccccggagtgcacgctggaaaatcttgtgacctgaaacatgagcactctgaccacgcgctcagtgaggtgggtgggatcacagggatctcccagtcaggcctcctcctatacagaagtctgaggtggccgggagagaaagaaagaaagaaaagaaagaaagaaataaggaaagaaagaaataaggaaag

SEQ ID NO: 387419 - DNA, 777 bp, Homo sapiens
caaatcctttgtctacaaacagactagttgctgttacactaaagaaaagcaagccatgggaggaggagaacatgaaaaaatagctaaataaacaacgcccagattgctgcatgggtccaagcctgcccaagaaagccaaaccaagcaaagcttctggcagagttgcggcagccaaatctgaatggtcccatctgtgcttctaccctagcttctcctcgcagagctaacagatgtttgcaaagctggaatgtccaccatctcatggataacagctgaaaattcacaccagtggaaagcacttctgcagaacaccaacgtcagcaaagacctcaagtctaacagaatggtcttcttcatgtaaagcaaagggaacagagggaggccaccattgattgggaaccactctgtgcctggtcctgtgctagcagcttccacgtgtactttatttaacacccgcaacaggcccaggaggagctgaagctccacgcagtcgtgagcagactcctggaatctcacatatgcctgatgtgagatgcatagcagcttccagacaaactctttagaatttctcaacattgatgctgtgggccacaatggttggagagaacttcccagagattttcgcctttgcagcagcttctgaactgtctctagaacttccttgggtctattggctgagacctttggccaaggtgtccctgattttctctctgcttgccctaccaatagtaagcctcaatcctgtttctaaaaaatggtttcatacttggaatatac

SEQ ID NO: 387420 - DNA, 425 bp, Homo sapiens
tctaggctcattcaggtacggtgctagaggaaagccaccttggggcggcaccgcatatgggagacccacagtccactgcacactctttcagtgggccaggcgctgcggtgcatcctacatagggacaagcctcacaaaatcacagctgggcaggctgcagcatttgacactggtacagtatagcaatggcaaattatcataaataatgtggcataagtaaaatataatttacatagaactacatatttgggtcctttacctaattgctggcaacagtgtctttgtatagttgtcatgccttacattttcctcatgcccatgctctatccagaccctctctgctctggtagagcacaaatgatattctccttaatactcttcccaccatatctggaactaatttatcttttcccctgagctgcagg

SEQ ID NO: 387421 - DNA, 337 bp, Homo sapiens
taaatgaaaacatgtctcatcctgttaatggtggtaggtcactctgacttgaaactttgaaattgctctggactttttcctctctctctccttccacctctaggggattctcctatacaattccatctccttgtaatttcacctttaaaacagctgttgaaaggctggttcacctccagtcttactctttcaacgcatctgtcccgctgctgtcacatcactgtcccaagataaagcttcagtcatgtcattcctgaactcagaaaccttaaatagctcctcactacttattaacaaaggtccaaaccattaacttggcatttagaggcccttactg

SEQ ID NO: 387422 - DNA, 263 bp, Homo sapiens
acctgggtctccacctcccccgagaagctctatgcccctattcattctgtaacctcaggataatataaaaacctcaaccatctggtccctcctgtgagtctcacacttcggatatggctcgtgtgtccatgtgcatgttaataaatttgtatacctttttttttttttttttttttttttttttttttttttttttttttttttttttcacaaacgcgttgtattcagagaggaggagaggaaaagagggggggggggagggg

SEQ ID NO: 387423 - DNA, 705 bp, Homo sapiens
taaagtgctttcaaattgattatagatattccttaaatagcattttctaacattacctgtcttagtaaatatcgctataactttttctctcccggtttctctttcagtaaattagaaatcactttacttaagtttaataagtgcctttcacatcctcattttgaggaaaatgatttctgccatcctaacataataaactgggaaaggtacaccgaggtgacatgctgtgcctgggccagcttagtcaatgaggcagcagcagcaaggactgagtttagcatcctgatgtttgtttcttcaagcaagaattaaacgcaaaattaaacactgactcagattttaagaaataacttttgagaaatagaacaaatgaaatcagtttctccaccacttaagtatatctcttagagatctacagcctccctttaggggacatacaaagtcagttgtgttgcctttgttgagtcccaccttatattcaagtaggtatgactacaaattttgaaaatagattgtcacacaataaactggagtttatggaaacatcagtagaaggaaatacaacattccatccctttacagagatcatttacttgcaactcaggataatttgtcatgtgtattatctacttatgcttgccactcacatgcagagaacttttataagaaggctggaaaaagaggggtgtagaggctttatgttga

SEQ ID NO: 387424 - DNA, 272 bp, Homo sapiens
aatacttacttggtttgtgttagtgcttgtaattcgcccccagaatgtgtacacgttctggatgcattaaagtctggcctgtatccttaaagggccatcgctgtgctgcctgccctcagcaaggacacactttgcagacccacagaggctccgcctccacctcacaccaaagaaagggaggagtccaaagggcatcagtgccattactcacaaaatgataaatacacccttattctgaaccacgtggagtcatatggtttgtgatccctgtc

SEQ ID NO: 387425 - DNA, 336 bp, Homo sapiens
ctctgctgtcatcctaggtacccagacgcccagacttgaagaagcaggggatacatctagactagagttccttcctagagaaggagatgctgccaactggccaggggacagatctcagagaagtgttgtgtatgcaggaacctcaacctggggccagggctgtttgcacatggactgggtgggtatccctttgcaggggcaggctctcttctttcctcctccagcaagaaggggcctggtttcatggtttaccaacaagagtggtgcttttgtgctgttcataagccgtggcagccagtctcctctttccttcttctgtgaacaagtgatttctgc

SEQ ID NO: 387426 - DNA, 308 bp, Homo sapiens
tggctttagataagttacagagtagtttaggcccacatgatttaagctcacccacagttctttgttgatacttgaggatttcatctgaaaagcatcctgttcatactctgaaaatatttctttcatcttagtactcccactcattttgtgtgtgtatatgtgtatagattattttattgttccacatatatgtatatttattttttgtccacttgctagggaacctcattttttttaacaagaaaatacttgtgtgataaggtcataaaacccaagagttgggaggaatattagagacctactttatt

SEQ ID NO: 387427 - DNA, 529 bp, Homo sapiens
ctgtagctgggattacaggcacgtgccaccacgcccggctaatttttgtatttttaatagagatggggttttgccatgttggccaggctggtctcgaactcctgacctcaggtgatccacccgccttggcctcccaaagtgctgggattacaggcatgagccaccgcacccagcccctatctctatttaaaatgagaaaaaaggaatctatttctgggagtctctctgaaccctctagtttaggaggctgcccaattaaaaaaatatatttaaaaacagaatatatttccaaaaagatgaaactgacacatactcagagaaaatgtgaacattctaaaaagacaaagaaaaaacaaaaattacttgtcttatgactaaaaagaaatagtaacattttgttgtccttccaggattgtttttctttgttcatattacctaaaaattttaaaaaagctgaaacccagcacggtactgtgtggccaccatgccatgtctagagccaggctcccgttgttggccatgccttgct

SEQ ID NO: 387428 - DNA, 769 bp, Homo sapiens
tgcctaggaatgaaaaactcataacagcaaacagaagcagaaatataattataattttatgaaaccttaacaacattgaggccacatgacatgacataatggcattaaagaactacagatctttaaggaaacaggtgttaagttaaagctgcctccaaagatagtgaactgtaacctaatttaatgtataaacaaactgtaacttaacataagagttaggttacaagtgtaacaaatagctgagtctcagccaatcatagcagctgaaacctccagccaattggaggctaaagcctgccaaaacatgaccaaataaggcaaacacataactgtagccaatcaggctatttctgtatctcatttccttttctctgactataaatatagcctgcacaacctccactatggggtggaacattctgcaccacttttggtcctgagtgttccctgaacctttttctactggattaaactctgttaaatttaacttgtctaaggttttctcctcttaacacaggcaacacttctaaataaaaaagacaatagcagtcccatttctccactctacaattacaatatgaatcctagacagtccattcttccgcatactttcctttggagcactggttctcagaggtgattctgcccctgggagaacatcagataatgtctggtgacatttttggttgtcacactgcggggaggggggatactggcatctggtgagcagaaaccagggatgctgctaaacattctgtgacacacagga

SEQ ID NO: 387429 - DNA, 618 bp, Homo sapiens
cacccagctaattttttgtacttttagtagagacggggtttcaccgtgttagccaggatggtctcgatctcctgacctcatgatccgcccgccttggcctcccaaagtgctgggattacaggcgtgagccaccatgcccggcctgtattagttatgtcaagaccaaatgctgtcaggctagagaactggggaaagctgatgttgcagttccagtctgaaaggcatcggctggggaattccctcttactcaggagagctcagtcttctgatctattcagaccttcagctgatgggatgaagcccatcatatgggatgaagctcccctatgttatggggagcaatctgctttactcgaagtccgcccatgtaaatgtcaatctcatccaaaaacaccttcacaaaatcatccaaactatggtttgaccaccaatctgtcaaaccgtggtccagccaagttgacacataaaattcaccaatacaggacccataccctcacgagggttcaagtctgttgcgggcctgggtgatacaaaagtacacaaatgaaacaagtgcagattgtggaaatggtatgaaggaaagcaagttgttaagagaggaaacagaggggaacctgt

SEQ ID NO: 387430 - DNA, 701 bp, Homo sapiens
catgtgaggagaaggagagagaactgcggctttttggggtagccagatctcgtggctccctgagccaggtttgtgactccctctttggggctctgtggttcctggcatcactaaacttccaggcatcaccgtgctccccttgtccagacacggtacccgcagcctgcatgctgtacatctggtccagcctcagtctttcacggagctggcacctctgctggctcctggagctacccacccgccacagcagctggcgagcctggctgtgtgcagcggatggacccagcacttgcttgcccacgcatttttcaccacttcgtgcctggcttgtttttggcaggtgtgggatcccggccagtagcaaaagccaagtgcagcctgccagacccagtaggcagaacaagcccagcaggccagagcaaaaacttgggcgaaggtaccaccagccacagaggtttccagctggtgaagtaacaccccaaagatcttgtgatataactggatgtattctcagaaatacggaacatatttattcagatatggctaagcaaaccgggaaacaaaacaagaacatgattaaaacattttattctcaaaattctgaggtctcagcagacaacatgcatacttgaaactatcatggttcaaataaatacacaaataaataaatcattatggtgtctgacaatactctcaactgt

SEQ ID NO: 387431 - DNA, 493 bp, Homo sapiens
  misc_feature (491)..(491): n is a, c, g, or t
ccgggactggggaatctgtagggtcaatggaggagttcagagaaggtgcaacatttctgaccccctacaaggtgcttgctacctgccaggcaccctttccataccttgtctcagttcagctccccaccttggataaacaagaaaccttggttgcagaggaaaaaagaggctggaaacaaaggggtagaaatggggtagcgggggagattgcctgatcaactgccaaatggtacccagttctggaaaagcacaaaaaatgtgcacacacgggttcttcccactttaacccctgaggaatctgaggcctgctcctgaaacagactgggcagtggctagtgactctaggtataggagtatccagccctgctcacccaggctagagctttggggaccaagaggaaagaggtgcctgtgggggtagaggacagagtctattttatattgggtttaatttaagcgggcgaagcttatttcccttagttaaggttaantt

SEQ ID NO: 387432 - DNA, 284 bp, Homo sapiens
ctgtgtgtgtgtgtgtgtgtgtgtgtgtgtgtgtgtgtgtgtgtgtgtgtgtcacaaagtctttcccagactggagtgtagtggcgcaatctcaacttactgcaaccacctcctcctgggctcaagcgatcctctcgcctctgcctcccggaatgtttgagattacaggcgtaagccagtgtgcccagcctatcctcagttcttagtggtactgtttgtattgcttctgttttctttgcccttctctggtgtctgttcttttctgccatgagtgtttctgtcct

SEQ ID NO: 387433 - DNA, 335 bp, Homo sapiens
accagaggtgcacacaaatatacctgcaataaagcatattctagctattttatattagttaaaattttgatagcaataaagtatctattaatatgccagttatttatttcttatatctagctaatctcattaataagcaaaacaacccctgaagcaggtattattactctttttttacagagaaggtaactgaggcttaaagaggataattaccaaattgcccggtgacaaacagttaggtagtatgtactgaatatggtgactgcaatctaacccgtctgtgtgattataatgcctttttgtaacttggtaaatgttaacaagtttttatactt

SEQ ID NO: 387434 - DNA, 426 bp, Homo sapiens
ctcactgcaacctctgcctcccaggtttaagcgattctcctgcctcagtctcccgagtcactgggactacagatgtgcgccaccacacccggctaatttttgtgttttcagtagagacggggtttcgccatgttgtccaggttggtctcaaactcctgacctcaggtaattcactcgcctcagcctcccaaagtgctggaattaacaggcgtgagccactgcgcctggccagaaaaacttttttattctctggatagtttagtttcactactaagatgtggccttctgtcaggaattgctagtgaatatatcccaaggaaccgatgagcacaatttccaccctccaagaacttatgactgtgacaaatccataaactcttctatttggtagtggattccaggccacatgtgagttctgggaactgt

SEQ ID NO: 387435 - DNA, 274 bp, Homo sapiens
cacatatccctcccccagccactcagttctctttctcatagacacttaacattattaacttctagcacagtgtcttaatacattatgaaccggaaagtctttagatggggcaaactcactccagtggccacattccccaccatttccctataatattataccagactgtatcatgattatgttatctgcctggccattgtaggaattgtgtctgtgatccagttggtgtggactggagtgtttggaaccttatggaacgggagggggatgggga

SEQ ID NO: 387436 - DNA, 348 bp, Homo sapiens
tgtgtccatattgcagacggcaactccaaactaacatggcagtcagactgtgtgatgtggcttctctgcttagaagtggttcgtgggcagcagagccttggaccggggtctgtgggatttttcttaaattctgtaggctacttttttttagcatgttggaggagtgctgaggccataccaaacacttgaatctttcatttgtcctaaagtatcagttttcaattttgcccactagctatggcagactgatttttcataatgagtttgcaccttgtctttctattttccccatcctcactataagactagcatgttggtcctccgagtattgcgtcccggtattgcggt

SEQ ID NO: 387437 - DNA, 661 bp, Homo sapiens
gggtcccacaccctacacgttctcccttatccttggacaaaagcatgaacacacccagaattttataaggctgtgctcaccgttgtcttcaggagacacaatccaaaaatataagtccataagatacttgaaacatttcaaacatattattcagatgaaccacgaggattacgaaaccattgaagcccattggaaatgagaaaagtgagtctatttagacactagcatgcccaaatgtgtgctcattgctgtggcacccctgaaatgagtgagatcttagaatctgaaaatgagcacatgcctagattctcaacaagaaagtgccgggttagcaaatgaatgaatggttggtgggaactcattcatttattcacttattcatacattcagcacatttactgagcacctactatatgccaggcactgttctgggcactgaaggcatgcagggagcaaagcagatgaaaatccccacccatgtagtgagagctggcattttagtaagagagacagataaaaagcaagatcaatagaacagtacattctcatgcctgtaatcccagcactttaggaggctaaggcaggcggaacacttgaggtcaggagttcaagaccagcttgacccaacatggtgaaaccctccttctctactaataataca

SEQ ID NO: 387438 - DNA, 281 bp, Homo sapiens
aggaaccatgttcataaagaaataggtcataaagtgaaatatgtaagtgcatatcacttacaattgtgtgcatctgagtttataattttggttatctgaaataccatggcagataactcaagttttctgatgagatcaatgaaaacccacaatgggtcacaacttcatatgcagtcactcttagagctgaggtggagaaattttatctttcacaaatatagatgtacaaagaggacatctcttcatttattaagtttcagtgtttacacatactaattaca

SEQ ID NO: 387439 - DNA, 2303 bp, Homo sapiens
tctggggcaaccctggcagggcccatccctgcctggtcccgctgagctcgggcacagaccgggcaccaggctcggtgtggagtgtgatggggagtggtgtccccggaggtgtttctgggaggtgctttttactcgtgttgaataataacaataacaagaacaagatggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaggtcatgagtttctttttactcgtgttgaataataacaataacaataacaatatggaaaccaccgcaaacttggagaaaagttgtaagcacagtaaagagaagcttccttctgagtcacttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgctttattctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaa

SEQ ID NO: 387440 - DNA, 1828 bp, Homo sapiens
tccgaggatccgatagcattcagcaggcgtgctgagcccacgccatagcccctgtgggatggtgggggagggggcgacccgaacaacagtgcagtcggtatcgagattggggagaggagcgagtccaaggagaaggtcatgagtttctttttactcgtgttgaataataacaataacaataacaatatggaaaccaccgcaaacttggagaaaagttgtaagcacagtaaagagaagcttccttctgagtcacttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgctttattctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaa

SEQ ID NO: 387441 - DNA, 2337 bp, Homo sapiens
tctggggcaaccctggcagggcccatccctgcctggtcccgctgagctcgggcacagaccgggcaccaggctcggtgtggagtgtgatggggagtggtgtccccggaggtgtttctgggaggtgctttttactcgtgttgaataataacaataacaagaacaagatggaaagccttgttgtcacctgaagcacgccaggtccagattgaccaatggttttctcacttcaggggccaacccacgccccctttctgctgaggtttgggtgccatctagtggtgggatgggacttggttgactacatttaaggtaaggtggacccagcaactcccagaaacaactccggggacaccactccccatcacactccacaccgagcctggtgcccggtctgtgcccgagctcagcgggaccaggaagggatgggccctgccagggttgcccctgcactgtgcattctcgcctgggaggcacaagttctttcatctgcttttccttcagaggtgctgagcccacgccatagcccctgtgggatggtgggggagggggcgacccgaacaacagtgcagtcggtatcgagattggggagaggagcgagtccaaggagaaggtcatgagtttctttttactcgtgttgaataataacaataacaataacaatatggaaaccaccgcaaacttggagaaaagttgtaagcacagtaaagagaagcttccttctgagtcacttgagtggttgccgttctggccctgcaccctctgtgctttgggacggcgtccaacccgcattcatgtcaggagtgagtcgcacgtggctttgtggtcatggcgacttaatccgcctggacggtggctccgtctccctgggcttagacgaccttggcacttctggagataagcccatggctcccaggttgtgttcatgtgacgtttccttgtggtaggttctgggtctgcgttttgtctaggagtgtcacaggatggacactgcctcctggcaggggctgcccaatgcagttagcctcctgctggtgttctctcttgttgcttggtgaaggtggccctggtcagcttctccactgcccagtgaacgacccctttgtaatgaatgagtggggaggtagtgtgaagcgatgccaatatcccatccctgtcaaactgcctttactttttccttccttccttgctcccacctgtgtggatcctggtcccttcttgtattcagggctgtggtctgttatgacatttactctcaggctcaggtcctgcttgtttggcccgtgggagccccttcttctgccttttgtgttttttttgttatgtacctacagttctttagctgtttctttactttctggtgcaaaaagatgttcaagccttattttatacttgcctgcccctttctctttcatttattggagtgagctgcagctctaagaagacctgttcttttgaatggagagtagcatcaggaaccaggatgtgggtgcgaggcgtgctcctggctgttgcagattgctgcacccgggagctcttagtggacagagctagaggatatgtgcacgtacttccatctctctctctgtctcatctattcacagctgggaatgatactaatacctccgattttagcccagcaccacagggtacgttccagtttttctctctttccatagctgtaaggccctttctgggaatggttctcattctccttaatctattattgggtcagttttcctgcatgtccccagcctcccatcactgccacccactccccacagagatgccctgctcatccgactggggctttgactcccacactgtgtacccctcttgtgtggacgccctgctgccaaaaccttcagcaaacagctttccaaatggaagttgtcactgtcagggcctttacaatcagcaacagcaaaatctacatgctgctgagggtcctgcctcattaagatgcaataaatatgtaagtacataaaaacagcaatagaagaaacgtaatgctttattctcaaatatgatgtctacatagaaaagccaaaattattaagaatagtaagaattcacccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaa

SEQ ID NO: 387442 - DNA, 255 bp, Homo sapiens
tcaggaacgctagacattctcccagcctggcccagggaccccctttggacttaatttcctttcatcctctgcaggcacaaaagcatcaccaagggtcacatattttttccagtttgtcatcttggcaagctgaatctgagaacatgtttgttgaatttctatcctcaaatctttccaggtttgcgtcaaagaggaaaagcttacagcatttccttccgtctagcttgctaagccaaatctaacagagaataatga

SEQ ID NO: 387443 - DNA, 345 bp, Homo sapiens
ctaagatcaaatgcaggcaaaagtggtgaattttaccacctgtttgtaagtctgggtttataactttaccgtaaatcacctagaacacaggctagccgaatcggggtgtctggtatggcaatatcccgagagctaacctggggctggggcaatgttctgtggctgctgcacttgcctctaacaggccagtttaaaacgtccaggtctcagggccacattctccaggacacagcagggagctcacagtagctcaagacccggcccagcctccatccccagccttggagctgtcagtgctcccaaaggctgaaagcattcggtcttggctgagtggacagccccctt

SEQ ID NO: 387444 - DNA, 400 bp, Homo sapiens
tgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatcaaataaacaggtggccatgaggctgaggtggctgcagtgcactcaattc

SEQ ID NO: 387445 - DNA, 358 bp, Homo sapiens
ggctcattatttttcagtaattctgctgacatgtatcatgttcacgggcactgcttcctcagcgggacaggaccaggaatacaggggcagcagacctggagtcggcagcaagctgggggctgagctgcaaagggctcgggtaccaggagaccctaatcgcttttgtcttcagcaaacatgctgcagtgcgccctcacagcacacacctgatgcagaaacccggcctttaccctgtctgccatgtgcttggtacttgcaaggtactgagaacagagctgtaggaatgaaaagtggcacgtggagggcaaggggtcggcctcggagctattgaggaaagggcaccgcaaaattctaacag

SEQ ID NO: 387446 - DNA, 214 bp, Homo sapiens
gtgatgaatacatccagttttccaaccacattccaccaggtgggtgtttggctgtgggacgcattatgtaatcttcgttgccaggaaatttaccttcctaattacattttgcaaatgttcatttgaagccgccttcttggagctcacagtaactaggaggtggctgctggaagccccagggcaccgtgggagggacaggggaacgtcccagacc

SEQ ID NO: 387447 - DNA, 760 bp, Homo sapiens
taggaaagggaaaaaacctgtgaaaaaacggatgatgcagtttttacgaataagcagcttaatgtatcttggcacccacagtaagccttgtaggagctcaaagtgcctcaggcaatctgtgagcagaatagcaattttattactttgtcattaaaccaatttcacagcagtattgtttgttaatgagcagcggcaaacgagcgaagatgtcacacactggaatagcagagagatttgtgacccaagctcacagcactaagatggaaagaccacggctataaaaaaggaaatactttgggatgaaatgcaaagtctatacagcagagcttgtgtttatgagctaccattttgctaagagctgtgagagaaataaaggtctggaaatatgcagttaaaacagggcctataaaattaaaaccaaattaaagtatagcagaggattactgcacagactgtactcgacaaaatatattttaagtgacgaggtgaaatctaaatcagttttgtttgaatttggttggtatttatgaaattcaataaaaaaaaatgaaaaaatatccaaacaaagcagccgcctcacccttgtgtggtctctgagccataaacgtgcatcactttgaggaaattcaacttgccaatccttaaataattagcaacttcttgattcacagggtgcgcccctccatcttcatgaaagccttctctgttactttatctcttcgtaaggacgttgcccatgtataataaacactcaggcgga

SEQ ID NO: 387448 - DNA, 544 bp, Homo sapiens
gtatcaacgcagagtggtcattatggccggggagtttgatctcagactgctgtgctagcagtcagcgagactctgtgtgcgtaggaccctccgagccagtgagatgaacccggtacctcagatggaaatgcagaaatcacccgtcttctgcgtcgctcacgctgggagctgtggaccggagctgttcctattcggccatcttggctcctgcatctccacattgaagtttcatgctggtgtgtctgacttggtggagtctaagtcacataactacaccttggctgcgaagaatgcttgggaaggagctcctggcttttaactttggaagataggatttatgaaatgggaaattatccaaacagagaacgacactgggcagtcaaaacagcttgccaaatggccagtgcagaggtcaagttgaatgaggtacaatggtgttctcattttacagatgggaaaactgaggtgcactgagtagctacagttggctgtactatgctctcttctccaatatttttgccatgcctcttagaagcattttgat

SEQ ID NO: 387449 - DNA, 393 bp, Homo sapiens
  misc_feature (6)..(6): n is a, c, g, or t
cgttantggcattgcaatgaatctcacatgctttttctgtaatttgaatatgagatcgtctctctcaaatcagaatataagaagccccttgaagactacatcaagtgttattcattcctagtaccctcccttccttccgaatgttgtccttctttctcctactcccaccccacaagacacatacacagacacacacacacacacacacacacacacacacacactcgtagacagggaggtatgatggcattctagatgcttggtggaaaacaatttggagaatgaaaagacaagccacgaacttggagaaaattttgcaaaacacattatctgataaaagacttctgtccaaaagatacaaagaacttttaaaagtcaacacccaatttttag

SEQ ID NO: 387450 - DNA, 626 bp, Homo sapiens
gactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcgctacttgagaggctgaggcagaaggatcgcttgagaccaggagtttgagggtgcagtgaactatgatggcgccaccacactccagcctgggagacagagtgagaccctgtctctaaaagaaaaaagaaaattcaagatacagagccagacaggagcctggatggccatctttcttctgatagcaataagctggatgctgggatagaagcctgatacctcctccaaccctagtccttggcctctagtttactcgcctgaggcaagggtagagtggaggaagatttagggaaagcaagtagtccgttttattgttacggaccagagaggttgggggtgc

SEQ ID NO: 387451 - DNA, 447 bp, Homo sapiens
cacatgctgttttaattatgaagaaatctggaaaccatattccagattgtgtcggttttcagaaagatcacctacaaggcaatcaaagctgataaattttgaaagatgatgactgaagcaagggatgtagaaagaaaagaaattttagcctctggatcaaatgaggtacccattgctaatactctcaggcccacaaaactagctggaaacatatctttctgtttctttaaccctgatcaaaactgcagggcacagctgcttcacatcctagtaatctttgtggactaactgcattttgttggcacagtatatttttaaaggttatatttattgttacgtaagagtctggggattttagttctcattttactttttcttataggtcacacttaaatactataattttgaatcaattataaggaaaacaaacataagcttagatccact

SEQ ID NO: 387452 - DNA, 251 bp, Homo sapiens
gtgggacacgaggaagcaaagagaggattgggaagtcataaatacaaggagatgagttaccacggtcagaagctaagaaaactgtcttcattaaaccaccactgacacagggaaagtgggaggaaaaatgaaaatatagctatgcaaaatgactcaggagcacaaaaagagtacaagggcaatccaggagatctgtttatttagatattagtaaaagcaggacctgggtgtagagagtcagggataggctg

SEQ ID NO: 387453 - DNA, 386 bp, Homo sapiens
aagctcccacagggaacgtcaagattttaaaggacttgagtaaaaagaatactggagagagatccagaaaaagcctgcaaagaccctaaggcaagagaatgcctgtgaagtccaaggaacagcaaggcacccaacatgcatggaatagagggatcaaaggagagagtaagggcaggtaaagtcagatagggagccagatcatggatgatcttgagggctctcataaggcgtttagcttcacctggtaaggagtgggaagccattggagggttttgagcagaggagtgagattatctaccttataccttaacagagtcactctggttgctgtatttaggaacaagggcagaagcaagaaggtaagttgggagcacattgccatttgc

SEQ ID NO: 387454 - DNA, 222 bp, Homo sapiens
  misc_feature (112)..(112): n is a, c, g, or t
  misc_feature (134)..(134): n is a, c, g, or t
  misc_feature (201)..(202): n is a, c, g, or t
aaaaaaacaaaacaaaaaaacaaaaaaaactttgactacttcacctaccctcttaattcttcattaaagaatgaggcttaattaaggcatacttagtcgtttagatgggttnatggaagtcaactgcttagttntgcctgaagaaagtttcgggttttcttttttctgtttttgttttttttcttttttggtctttcttgnnggactgggctaaaactgtag

SEQ ID NO: 387455 - DNA, 709 bp, Homo sapiens
taagaaatttttgcccaccttttctagttgttcccagaggaagagttcagtttgataccagctaccatgtcatgccctgaagcagaactcaactccttttgaaagcggatggcatataaagcaatcagtattttaaaaactcaacattcaacacttaatttgccaaaaaaaatgaccataaaaaaataaaaacagcctttcactgcctgactgccgccgtcacgggtcacattcatgtgcccgggaagggcctgtcccagtcggctttgctctatcaccacagcgtccccacttggctgaagttgacatctgacaatgtgaaggagcagatttacaaactgaccaagaagggcctgactcctccacaaatcggtgtgatcctgagagactgacatggtgctgcaaaagtgcgttttgtgacaggcataagaattcttaagtctaagggacttgctcctgatctccctgaagatctctaccacttaattaagaaagcagtcgctgttcaaaagcatcttgagaggagcagaaaagacaaggatgctaaattccttctgattctgatagagagccggattcaccgtctggctcgatattataaaaccaagcgagtcctccctcccagctggaaatatgaaccatctacagcttcgccctggttgcataaatttgtctatgtactcaagcaataaagtgattaaaaagaaaa

SEQ ID NO: 387456 - DNA, 804 bp, Homo sapiens
agcgggtctctgagtctctgtctctctctgtctcctcacagtctgttactacttaatacagtgcttattggcctgagattggacattatttaaaagcaatttggagagttttctccatttcaggcaagaaaacatgcactatttttctgatatggcatgggacatcgaaaaatagttttgaacaaaattttgaaatttttggcccaaagaaagcaaataccccctgcaacaaacaagatgtgtcacaataagtcatgatttacaatccctttcaagactgcctgttgcccttagcaatccctaaagcaaaaacaaacaaaacaaatcttttcagcatatcttcatgaaactgtctgggatgtgacaaaactttgagaaacagttttgtgataatggttttgcactttattggtacttctccacaggaggtggtgaatggctactttcaaatacatagagctatcaaaggctaaagtcaataaaaaacctccatagaataattggagaggaaagaaaagggggaaaaaaagaacataaaacgaatgaaaaggcaagtaggacctataaatataaaagcctaaggagtatattttgggagaacagatgatgcaaagcaaaattgggaatagttattggaggatcaaggaaggcaaataaaacaataagatatatgatgcctgtcctcctgcctcaagtctagctcatcagacagtttttcattccattttgtatatatgagtttcatctgactactgccaacagaaagtgcttggatttcctgacttttttcactgtcaaaagaaa

SEQ ID NO: 387457 - DNA, 752 bp, Homo sapiens
agccctgtcagtccctggggaaatcgttacttaacctcccccacccagcccagcagaaacatcacccatctacagcatcccctccacctgtggggggattctgtggaaccctagactttcaggccagtctaacccagtgggttacaaaatgggaaactgaggcccaagaggggcaggattctacctggccacacgcattcagtgagaagcacagtggttgcaagcctgggctctggagttggacagatctggtgcaaatcctgacaaatcacttgtaagctgtgtgagcttaggcaagtggcttaacctctctgaacctgtgtctttaccagtcaaaataaggattataaacgtatccacctcaaagggttgttgtgaaggaagtgcacagcttggtgctgcggtaagaggtcaagaactattcgcaatcttttcctgggttgtttctgccgggtgggggtgtggggcaaatgctgtctgcctgggtacagccactcactgcttccacgatggaaagatggccagtccgctcccaggggcagggccaaccacggtcgcccaggcccaggtcttctacctcccagcctccgggagaacacagcccaggtctgggcctctcctgcattccaccctgtaggggtggccaccagccctcttagaagccaaggcactgtgtgactcccgtgatctcgtgtgacccccagctcttgctgatgctgtcttcatatcctgatgaaagactctgacctctg

SEQ ID NO: 387458 - DNA, 354 bp, Homo sapiens
ttttttagcattgaattctgttgtgtgaatatcagacaattaatcactccgtgctgatgcacatatgcatgtgttttagttgagggtattaggaacagggctgctatgtaaattccagaaaatgtattggtattggtgaaacatgtacaaatttctgttgggaacatgtgtaataatcacattgttgtgttgtatgtttacgtctcttcagctgtaggtgatattaccagttttccaaaattgtaccactttttacttgtaacacttttcatgccaacaagtaacgtgtgaatttcctagggtacccacatccttgccaacacatggtttttttttttttttttgagacggagt

SEQ ID NO: 387459 - DNA, 1178 bp, Homo sapiens
agcggtaaaagttattagttctaaagggagaggtagattccgatacgataatagttagggaatttaacaccctactctcaggattgaacaaataatctagacagaaaatcaaccaaaaaaaatagatttaaactgtattttagaccaaatgaacctaacacacatctacagaacattttacctgacagatgcagaatatatattcttctcatcagcacatggatcgttctccaggacagatcatatgttacgccacagacaagcctcaaaatatttaaaaagtcaaaatcaatcacatatcttatcagacaacattggaatgaaactagaagtcaataacaagaggaactttgggaactatataaactcatgtaaattaaacaccatgctcctgaatgaccactgggtcaatgaggaaattaagataaaaatccaaaaatttcttaaaacaaatgaaaacaggaacacaacataccaaaacctatgggatacagcaaaagcagtgtgaagagagaagtttatagcaataaaagcctatattaaaaaatagaaagatttcaaataaataagttgatgatgtacctcaaggaactggaaaagcaaaatcaaataaaacccaaaatcaaccaaaggaaagaaataaaatcagaacagaactaaacaaaataaagatgaagaatcaatacaaaggatcaacaaaacaaaaagttagtttttaaaaaatacaagaaaaattgatgaaccactagctatactaacaaaaaaaatagaagacccaaataaaatcagaaatgacaaaggagacattacaatgaacacacagaaatacaaaggatcattagagactgttatgaacaactatacactaataaattggaaaacctagaggaaataaagtcctgaatatatatatcctactaagattgaaccaggaagaaacagaaaacctgaacagacaaataatgagtaatgagattgaatcagtaatgaaacatcttccaacaaagaaaagccgaggaccaaatggttttactgctgaattttactaaaattataaagaacaggtaacgtcaattcttctcaaactattccaaaaagtggaagaggaaggaattcttcctaactcattctatgaagccagaattaccctgatatcaaaaataagacaaggacatgac

SEQ ID NO: 387460 - DNA, 390 bp, Homo sapiens
acttttgaaaagtggtttctctttcttctgaatgatcctgacatgtacatttacctctatcatggcaaaaggccgtcctctgaaagtcacagctgtattagagtgttagcttttggagacaaagacttcagtttattaacctgtgcagttcccacagcatatgtcctctgtggaatctgtcattcatcttttgtctctgtgctctgcctccttaattggagactatcattcttaatggtctgtcggactaggctgtctgagtcttcctttcagaattctgttgctttggtgtctctctacactattagtctcaggaagcaccctacattatgctgctgccctgaggtttgggctgttctagaagcatatccttttctatcagggactgcc

SEQ ID NO: 387461 - DNA, 432 bp, Homo sapiens
gatggggaacctaagaatgtaaagactcagtttcctgctctgcaaaatggggagaataattggagccactttagtgggaagttatgaaaattaaataaggtatacctataacctctttgaacacctcctggcatagaagatgccattcttggctattttcctgttacttttattagtggagttgggtcaggtgggaatggattagaagaattgcatgtggtggttaaaggggatttttatctttaaacttaatgcttttaattttttcaagaaaatatgagtatattatctgtgtgctttaaaattgatttttaaaaagggagataacaataataaaagtccaatattgactacttgggaatctgcaagtagaattatgacattttctctttatctgacatgtcctcagtttttagtcatctctgaagtctg

SEQ ID NO: 387462 - DNA, 484 bp, Homo sapiens
gtcctggtaatacctctttctttcactctctcattgcactttccccaccctcttccccactttgtatgtcctttcctaatctaacctgttagttttgcataattttgtcagctgcagaaatgatcaggtgctctttaggatatgtacagtggtagtgtttaaaaagtagttttaagagacatccttgttaagagtgaagaaaaattgggccaggcgcagtggcacacacctgtaatcccagccctttgggaggccgaggcaggtggatcacgaagtaaggagatcgagaccatgctggctaacacggtgaaaccccgtctctactaaaaatacaaaaaaattagccagacgtggtggtaggtgcctgtagccccagctactcaggaggctgaggcaggagaatggcgtgaacctgggaggcagagcttgcagtgagctgagattgtgtcactgcgctccagcctgggcgacagagtgagactcc

SEQ ID NO: 387463 - DNA, 276 bp, Homo sapiens
ggaggcagctgttctaatggaaagaatgtggttgctgaatcgagaactgtggcccaaggcttggtcccaaactcttctatagctgcatgaccttgataatgagttagcttcactgagctttggtttcctcatctgcatgagataaagcaatgcacttccacatccaacagcagtgcctggcacacagggagtgcaccgcaatggccgcttttatttgctcttccagttggcccccttcctagaggatgggccaaaagatgccaaaaaagaggacac

SEQ ID NO: 387464 - DNA, 472 bp, Homo sapiens
gtatgaatcacatcactgcattgtatgattccagggctctcttgcccatggctcgtgcatgaactaggaagtgatcatagttcctgttcttgttttatgaaaacaatagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaataatcggcactcacctttgccctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacacacatcccctacagctccctgctggcatctccttc

SEQ ID NO: 387465 - DNA, 1491 bp, Homo sapiens
agaggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttac

SEQ ID NO: 387466 - DNA, 2984 bp, Homo sapiens
agaggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaat

SEQ ID NO: 387467 - DNA, 2864 bp, Homo sapiens
agaggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagaggattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaat

SEQ ID NO: 387468 - DNA, 2261 bp, Homo sapiens
agcggagcgggagcacgagtgagcgcgggcttgagacctgctgagcagcgggacctggcggctggcgttctggtgtggggccgagaacagacccttcttctgaaaagccactggccccttgttctatgaagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaat

SEQ ID NO: 387469 - DNA, 1495 bp, Homo sapiens
  misc_feature (1447)..(1447): n is a, c, g, or t
agaggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaaggtaaaagatgagacccttacagacgcaaatagttgacctgcatgtcaaattttacttattttttaagaaaataaaacagtacactatgctcattcattttgtgtatgtttttgtaattcaagtgttgaataaaagagcaaataagaagcatgttgaacaaataactctgccagagatacaacacatgctaaataagatgaaaaatagtaattaatattttgtattaatgccactacattatagtttccattatgagccaccaagaagcacacagaaatattaagaacttagatactgaaagtaatcattaaaattaatttgctatctgctttgcccacaatgtaaaataaatggattttttatcactatacngtggagttttaatgttctattttgtgatcttattaaatgagttgaatg

SEQ ID NO: 387470 - DNA, 1721 bp, Homo sapiens
agaggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagtttttacaagaccaaccttggaaactttcttaaccaaaggccagttgtgcttggataccacatt

SEQ ID NO: 387471 - DNA, 2729 bp, Homo sapiens
gtgactctacaggatctcccaaacaccgcaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagatgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaat

SEQ ID NO: 387472 - DNA, 1118 bp, Homo sapiens
gagatggctgcactccagcccgagtgacagagctagactccatctcaaaaaaaaaaaaacaaaaaacagaaaaaaaaccatttggtaggaaaggagtttgaaacaattaaagtatatattttagtggcagatgctgccgtcattctctattcctgtagtaagcagtgtcttaggcctgaggaagtaataacttctgttttatctctctggaccttctttacaggcgggatggttaaataagtagatgaaaaaagtagaaacattaacatctagaagtaatttgcacagtgatcagcaaattatcctggcagtgatttaaaactctaatggtctccttggcttttgccatcatctccagggcaggtctggctgtggacactgtgtgaattcagagatgtaactgttttgtcctcacaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387473 - DNA, 2322 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387474 - DNA, 2198 bp, Homo sapiens
ggctggtacggtccgagtcttaggatcgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387475 - DNA, 1812 bp, Homo sapiens
tacctctttctcaaataggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387476 - DNA, 431 bp, Homo sapiens
cgaggccacacaaactccacctgtgtccctggctatggactagagcttcagggaattagtgatgtatcagaggatagaagcaaaagaagtactcactgctttctcttcatatacccctcaaaaattgtgagcttactcagtgagcttgtatttttctgatttcccactgatagagattccatttttcgaaggagtaactttttagaagaaaaatgtacaaatactctttctttcataagaaaaatctcagggaagtttcttgtttcaggcaagaatggggatactcttccactctctaaaaatgcagatcatttactgcacctaaagacaaaggtaaggaagtttgtttaggctctgaattctagagcctgaattctaggctcataattcccattctgaattttgaggttacttagtttgcatcataaatt

SEQ ID NO: 387477 - DNA, 4842 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattggtgagttcttcactgctacctcccaaatcttcttctgaatcttaaagttctaaaagcaacaagtacaataaggtaagaggacagagactcagaataaaggtagctagtaaatcagaatacaggtagctagtacatttcttggaggagaggggcttttgttttacagattccctggtttgtgttcccacagttcttcgggaggctctcggggaaggggctggcctttgtatactggcttttgctgatttgactatttgtctactttgcgagtaagcacataaatcttacacagaaaagtgattaggccagtattcggaaggtgaccctcatccggaagtatcattgatttggctaacttgctttcaactttgaactctggggtatctgaataacctggtttcattaaaggaggtacaggctgaggttttgacctctgtgccccttcgctaaagctactaaaacgctgtctgcaggcttgaggaactggtcttaacatcttcgaaaaacccagctaggaaaattcttcatggctgtgatttacatgggatacgagcattttcttcagttttagattctgtcctctttgccagctgctgttttgattcaccctgaatttgtatggcttttctgggcaggtgctttgtttcctaggagcattgtggccatgcctgtcctgcactttgggcttagattacaaccatcacacggtgttttggtgtgtttgtgaaggtgggggtggaaggaacatgggggaaagcagcagatggctctaaaggaggtgtgcacggggatgtgtcactggaatcatctcgtgggccctgcgacctctgggtgtgggaagcagagctggctgacaagtgccttctgcaagatgagtgatacaggaagggcccctcccactctcttgcctctttgtaattgagcccagatcattttttccaaagcattggctttaagttcatcgcttccttacagtaggcatagctatttcccaggaagtcagagacaaaatatcatttctttggccagaggccacctcgaggtgtcagtgacatcagcacaggtggtttgtgttgaggtttcgcctggggagaactccagtcacttgtccagtctgtgatctggttgggggagagtctagaaagcacagaccctgtgtgggctgagctcctgcacttgccagtttgttccattctgacaaagtgatactgatgagacaggccagaagccgcagaagggccctttgatcttgctgcatggagttaacaagctctctttgcctcatacacccaccctctacagtgtggctgcaagagtagcttcagctctttctccctctctctccttttcttctttttttcccccctagtttttctgaatagaggtattatggctacagctgttttcccgaattaacgaatgtcagggaggtactgaatatatatgatggttagaagatgatgttgggctcaaaatgcactacagatctttggtctgcagaagcccaataaaagtaaccatttaaacaatgtgtctttgtttttttagccccttccaaatgacaaaaccttactctacaatccatttcctcccacgaatgaatcagatgtcatccggaggcgcacagctcatgcttttaaaatttctaagatatataaggtaaaacatcttgtgttgttattctggatagttggttcctttgtgataccaaaatgtaataaactccacaatcggaagataagagcaccttcagtttccatgcagagaacctggcttgtgggagacaagtcacctttttgaggctggctgtcccttgtatatgttttattgttcttgccttagtaggttagaggcaggcacatcatacttaaccaaaatgaaatgcgtaagtagtgagaaatgttggcgctgagggtagagtctttgttgtcatgagagctggctttaaattttacttgttggagtgttccataggataaatgtcaagcaggctgggcttggtagctcatacctgtaatcccagcactttgggaggccaaggcaggtggatctcctcagcccaggaattcaaaaccagcctgggcaccatggtgaaaccccatcactattaacaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttc

SEQ ID NO: 387478 - DNA, 2212 bp, Homo sapiens
aactaggctagtagaggccgcggttaatcggacgagggcacgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387479 - DNA, 2268 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387480 - DNA, 4878 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattggtgagttcttcactgctacctcccaaatcttcttctgaatcttaaagttctaaaagcaacaagtacaataaggtaagaggacagagactcagaataaaggtagctagtaaatcagaatacaggtagctagtacatttcttggaggagaggggcttttgttttacagattccctggtttgtgttcccacagttcttcgggaggctctcggggaaggggctggcctttgtatactggcttttgctgatttgactatttgtctactttgcgagtaagcacataaatcttacacagaaaagtgattaggccagtattcggaaggtgaccctcatccggaagtatcattgatttggctaacttgctttcaactttgaactctggggtatctgaataacctggtttcattaaaggaggtacaggctgaggttttgacctctgtgccccttcgctaaagctactaaaacgctgtctgcaggcttgaggaactggtcttaacatcttcgaaaaacccagctaggaaaattcttcatggctgtgatttacatgggatacgagcattttcttcagttttagattctgtcctctttgccagctgctgttttgattcaccctgaatttgtatggcttttctgggcaggtgctttgtttcctaggagcattgtggccatgcctgtcctgcactttgggcttagattacaaccatcacacggtgttttggtgtgtttgtgaaggtgggggtggaaggaacatgggggaaagcagcagatggctctaaaggaggtgtgcacggggatgtgtcactggaatcatctcgtgggccctgcgacctctgggtgtgggaagcagagctggctgacaagtgccttctgcaagatgagtgatacaggaagggcccctcccactctcttgcctctttgtaattgagcccagatcattttttccaaagcattggctttaagttcatcgcttccttacagtaggcatagctatttcccaggaagtcagagacaaaatatcatttctttggccagaggccacctcgaggtgtcagtgacatcagcacaggtggtttgtgttgaggtttcgcctggggagaactccagtcacttgtccagtctgtgatctggttgggggagagtctagaaagcacagaccctgtgtgggctgagctcctgcacttgccagtttgttccattctgacaaagtgatactgatgagacaggccagaagccgcagaagggccctttgatcttgctgcatggagttaacaagctctctttgcctcatacacccaccctctacagtgtggctgcaagagtagcttcagctctttctccctctctctccttttcttctttttttcccccctagtttttctgaatagaggtattatggctacagctgttttcccgaattaacgaatgtcagggaggtactgaatatatatgatggttagaagatgatgttgggctcaaaatgcactacagatctttggtctgcagaagcccaataaaagtaaccatttaaacaatgtgtctttgtttttttagccccttccaaatgacaaaaccttactctacaatccatttcctcccacgaatgaatcagatgtcatccggaggcgcacagctcatgcttttaaaatttctaagatatataaggtaaaacatcttgtgttgttattctggatagttggttcctttgtgataccaaaatgtaataaactccacaatcggaagataagagcaccttcagtttccatgcagagaacctggcttgtgggagacaagtcacctttttgaggctggctgtcccttgtatatgttttattgttcttgccttagtaggttagaggcaggcacatcatacttaaccaaaatgaaatgcgtaagtagtgagaaatgttggcgctgagggtagagtctttgttgtcatgagagctggctttaaattttacttgttggagtgttccataggataaatgtcaagcaggctgggcttggtagctcatacctgtaatcccagcactttgggaggccaaggcaggtggatctcctcagcccaggaattcaaaaccagcctgggcaccatggtgaaaccccatcactattaacaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaagggagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttcaaaactaatttgattctgattatgtctttctgttca

SEQ ID NO: 387481 - DNA, 2206 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatgatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387482 - DNA, 2267 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387483 - DNA, 2151 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387484 - DNA, 2055 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387485 - DNA, 264 bp, Homo sapiens
ggcaggtctggctgtggacactgtgtgaattcagagatgtaactgttttgtcctcacaggaacagtggaggccatgtgtcttttggcagtcagtccagatgggaattggctagctgcatcaggtaccagtgctggagtccatgtctacaacgtaaaacagctaaaggtgagcatagggtttcatggcagcagtttgaatcattgtacaggagccagttcaccctgcagttacaagattcaaggcagattggcatgacctggaaa

SEQ ID NO: 387486 - DNA, 344 bp, Homo sapiens
agtgtgtgttggggggtgtgtgtgtgtgtttagtcctataaaatgtttactattgattttttctgtttactacctctttctcaaataggttggttgtgaagatggatctgtgaaactatttcaaattaccccagacaaaatccagtttgaaagaaattttgatcggcagaaaagtaagcgtcatttttcatggggcggtaaatagccttaacaagaaattaagtttctgtgccactggggatgggatattttcccatgaatccaggtaatattttatctctactgggtacagggagggtatgtgctagaagccatccccagcccaggctttacccattgtatag

SEQ ID NO: 387487 - DNA, 341 bp, Homo sapiens
caagcaggctgggcttggtagctcatacctgtaatcccagcactttgggaggccaaggcaggtggatctcctcagcccaggaattcaaaaccagcctgggcaccatggtgaaaccccatcactattaacaaaaaaaaaaaaaggagagttctgtaaattactgattactcaaatgactcaaatgtgattagcttcttgatgcatttgtagcttgccagttgtcagttgccttaggctgggtatggtgattcacgcctgtaatctcagtactttaggaggttgaggctggagttcaagaccagtctgggcaacatagtgagaccctgtctctacaaaaaaaa

SEQ ID NO: 387488 - DNA, 1977 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387489 - DNA, 2363 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttgaaaaaacaaaaaaacaaacccaaaaacacacaccaaacaagg

SEQ ID NO: 387490 - DNA, 1456 bp, Homo sapiens
agagaagattagaggcgtgtactcgtttgtaatttcagtccgcgggacgaggcgtttagtgtgtaaattacatggtgccgtgggctgccaatccatcattcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387491 - DNA, 1587 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacgatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 387492 - DNA, 4050 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387493 - DNA, 2665 bp, Homo sapiens
aagaaaaacactagctaggaggaggcccgggttaatcaggcagaggctgcacaatgtcatccttgcagagctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387494 - DNA, 3996 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387495 - DNA, 1535 bp, Homo sapiens
tcagctcggtaccgctgagcagctggcagcacctgttctatggacagtgaaggcaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387496 - DNA, 2873 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387497 - DNA, 1167 bp, Homo sapiens
ggacgcgtgggtcgacccacgcgtcggacccacgcgtccgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387498 - DNA, 2770 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaagctggacaaacattcctgtgctggatcagcagatcgagtgagatcctgagag

SEQ ID NO: 387499 - DNA, 1311 bp, Homo sapiens
gggttttgggtgggctggaactttgcacttgatgtgttgtaattcatcttctagaggctatgttgtgaaggtccttggggtgatacagccttggaaaaatgttgtttccctgtggattacctaaactagatccaagaacatgaaagaccatccctcagggagctggcatttgtctaaaaaccagcattccctgtgccatttgattgtggttcttgctccactgcaaatgggtgacttgcaatgtctcactaatgccactcttgctctttcctccaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387500 - DNA, 1107 bp, Homo sapiens
acctgcggcctcacagtgagacattttacccttatgccgtggaagactcctcgcgtatcatattgatcagaagcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387501 - DNA, 825 bp, Homo sapiens
ctctgtgtggctcatggtggggctcttcgggtggcccattgcggggcgcgttgtgtggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387502 - DNA, 734 bp, Homo sapiens
gggttttgggtgggctggaactttgcacttgatgtgttgtaattcatcttctagaggctatgttgtgaaggtccttggggtgatacagccttggaaaaatgttgtttccctgtggattacctaaactagatccaagaacatgaaagaccatccctcagggagctggcatttgtctaaaaaccagcattccctgtgccatttgattgtggttcttgctccactgcaaatgggtgacttgcaatgtctcactaatgccactcttgctctttcctccaggcatatctcacagatttcctctgccagtttgctcagcagccctgctacataatgttttcaggccaccttaatgacaatgagaggcgagttctacagaccatcggcatctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387503 - DNA, 3918 bp, Homo sapiens
  misc_feature (399)..(399): n is a, c, g, or t
ccgagcggaaggcggccacgctcggaaaaagaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387504 - DNA, 3425 bp, Homo sapiens
actcagaggatcctaaaagtgcactcttctatattacgatctgtaacatggaggagctggaaaaaggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387505 - DNA, 3796 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcccttcgcccccccacaacagccctcttaaaactaattggctttttagatacaccccacaaaagctcagaaattggctttaaa

SEQ ID NO: 387506 - DNA, 3999 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387507 - DNA, 4191 bp, Homo sapiens
  misc_feature (531)..(531): n is a, c, g, or t
  misc_feature (1748)..(1748): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcgaggcatcatgacgtgtccttcnaatccgttggatgataggacgaccgcgttgtgcagtctgtatttgtagcatgtcaagacgcccagataattcgagccagcagagcactggacaaagccaagagatctatgcgcctcgttcgactcgagtcgctccatgttatccgtcaagagttaccagtaatttgactcgccctgatacgatcgctcttcgaacattgtggcctcacgtgagcgaatctgtcacatgtgacgccggtgttccccacgtatttgtgaaagcccgtggttaccagtgggcacccaaattgtcgagacagtgggagcggctcgatttgtccgcaaactgcttggtgtcagggcaaataaattggcagagctccacagcagacagagattcctgtcagggcttatgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387508 - DNA, 4347 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcaggtaagagagcagtggggagtgggcttcctactccctggctgatagaaatgaaaattcgtattttggtcctgagttattttaccctcttactagccttgtaggacagttaagtaaaatgggacctgtctgatctgtttggcctaagaaacatggacaaggaaatctcccatgttttcttgtcctgtggataataccctcagtgtagactgtatttcttatctgactggccagttccctctcatctcctatgtctctgaaattgatttccctgaagcaaatgtccttattttctcctagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387509 - DNA, 4014 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattataaaaaatacatagcaaaaaaaaaaaaaaaaaaaaaaaaaaaaaaaaacaaggaggggggaggcgggatcaggaatcccaaggagcgacatcgagaccaggaccgccgcatcattatcgtgggaacaaaggaaggcggcccccaataaatcgcaggctggatactatacatgagctcgaaggcagacggagcagcctggtcaatacatacaagcacagcgcagcacgaagagcggacataagcagagggcactgcacgcgagggaattccacaggcgcagggaaggaacccacgaaaggccctagggggggccgaggcgccaataaacatcccgcgtggaacagaggatctccccccaggagacacaagtatttaacagaccgccttgaccggggagaggaactatccatgtaagagcctttatgaccacagtggtatttctcctcggtctttaacaaacatgcaagccggcgcaagtgccttggcgagccgctgctaagagaaccagtaaactgtctgcggtcaacggaggggcgctacaagtatgctgtcgacacaacgtcttt

SEQ ID NO: 387510 - DNA, 2907 bp, Homo sapiens
  misc_feature (531)..(531): n is a, c, g, or t
atggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggcaaaaattgttatccgggagctattgcctaatgggttgagagaatcgataagcaaagtgcgctccagtgtggcctatgcagtgtcagccattgcccactgggactggcctgaagcttggccccaactcttcaacctgctcatggagatgttggtgagcggagacttaaatgccgtccatggagccatgcgtgtgctgacagaattcactcgtgaagtnacagacacacagatgccacttgttgctcctgtcattctcccagagatgtataagatcttcaccatggctgaggtgtatggtattcgaacccgttcccgagccgtggagatttttaccacttgtgcccatatgatctgtaacatggaggagctggaaaagggtgcagccaaagtcctgatctttcccgtggtacagcagttcacagaggcctttgttcaggccctccagataccagatggccccacatctgacagtgggtttaagatggaggtcctaaaggcagtgacagccctagtgaaaaacttcccaaagcacatggtgtcctccatgcagcagattctgcctattgtttggaacaccctaaccgagagtgcagctttttatgtgaggacagaagtaaattacacagaagaagtagaagatcctgtggattctgatggtgaagtcctgggctttgaaaatctcgtctttagcatttttgaatttgtccatgctctactagaaaatagcaaattcaaaagcactgttaagaaagccttgcctgaattgatttattatattatcctgtacatgcaaatcactgaggagcagattaaagtatggacagccaacccccaacaatttgtagaagatgaagatgatgatacattctcctatactgttagaatagcagctcaagacttgttgctggctgtggccacagatttccagaatgaaagtgcagcagccctggctgctgcagccactcgacatttacaagaagctgagcaaaccaaaaacagtggcactgagcactggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcagtgtctcctttcctcttgggccgggcactttgggctgccagtcggttcactgttgctatgtcccctgaactgatccagcagttcctacaggcaacagttagtggtcttcacgagacacagcccccatcagttcgaatttctgcagtgagagccatctggggttattgtgaccaactgaaagtctcagagagtacccacgtgctccagcccttcctccccagcatccttgatggcttaattcacctagcagcccagttcagctcagaggtcctcaacctggtgatggagaccctgtgcatcgtttgtacagtagaccccgaattcacagcaagcatggaaagcaaaatctgccccttcaccatcgccattttcctaaagtacagtaatgatcccgtcgtcgcctcactggctcaggacatcttcaaggagctgtcccagattgaagcctgtcagggcccaatgcaaatgaggctgattcccactctggtcagcataatgcaggccccagcagacaagattcctgcagggctttgtgcgacagccattgatatcctgacaacagtagtacgaaatacaaagcctcccctttcccagcttctcatctgccaagctttccctgctgtggcacagtgtacccttcacacagatgacaatgccaccatgcagaatggcggagagtgcttgcgggcctatgtgtcagtgaccctggaacaagtagcccagtggcatgatgagcagggccacaatggactgtggtatgtgatgcaagtggtgagccagctcctggacccccgcacctcagagttcactgcggcctttgtgggccgccttgtttccaccctcatctccaaggcagggcgggaactcggggagaatctagaccagattcttcgtgccatcctcagtaagatgcagcaggcagagacgctcagtgtcatgcagtccctgatcatggtgttcgctcatctggtgcacactcagctagaacctctcttggagttcctgtgtagcctcccaggacctactggcaaacctgctctagagtttgtgatggctgagtggacaagccgacagcacctgttctatggacagtatgaaggcaaagtcagctctgtggcactctgtaagctgctccagcatggcatcaatgcagatgacaaacggctacaggatatccgtgtgaagggagaggagatctacagcatggatgagggcatccgcacccgctctaagtcagccaaaaacccagaacgctggacaaacattcctttgctggtcaagatcctaaagctgatcatcaacgagctctccaacgtcatggaggctaatgccgctcgccaggccactcctgcagagtggagtcaaggtgcaccaggcccttactcccaggagacttttagcctggcagatcaagttacaaattgtcaaattatcaacttg

SEQ ID NO: 387511 - DNA, 1420 bp, Homo sapiens
taagagcctgtcaacacttatatctccaggttctttcattgagactaaccaggagggtttggccatttctgattctctttcactggggactacaagccacattgcagaagcctttggggcccttctattctggcctatttggatttggggagggaaaatgcatgaatgtgctctagctctagctgcttttcatctccaagtagatgactccaatgatatgtgggaggaccaggaggaggaagaggaggaggaggaggatggtttagctggccaacttttatctgacattcttgctacaagtaaatatgaggaggattactacgaggatgatgaggaagatgaccctgatgccctgaaggatcctctctatcagattgatctgcaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaaatggggaaaagggattttttttaaatccacctgacccaactatatttaatatgcctctcccacacattaccacagagtctgatattcaaaggttatcccctttccctcaggaagcctctaaagtgcttaagttgtagccctcaaatttgcaacatgtatttttctaggacagtaaagtaatctttacaaatgaatttagttgcatggta

SEQ ID NO: 387512 - DNA, 229 bp, Homo sapiens
ttacctagttttcaaattcctaggtttttattgcttttagtaaaaaaaaaaaaaaaaaaaatcactgggaaaacctatgtactgggttgaatcttttgtttagactgttttttttttttgcctttttgaaataaaatgtatatgatttaatgtgtagaagtggaaactagaaaaatattatgataaagacatgtgaatccatatattcaaaataaagcagaaaattata

SEQ ID NO: 387513 - DNA, 405 bp, Homo sapiens
ccggcctgtgcgcagttcccgtgccctaggagttggcggcggggcccagccgagaatcttcttcccttctggtctgactaggaaagccagagggagatggtgaaggagacacagagagagtaaaagaacagaccatgcccagcctctccactgcaggagcttggaatcagttcctttctcaggaacctgaccatcaggcctcccagaaagtatcgagaaactgaaacatctcagatcatggcatctggacaatgagacacacctgctgcctgttgaccaactccccttgcttaccccttcgtaactccccactatgtaaaccctttattttagttagcttagacttgtctcccatctctcagctgacatcatctgtaataaagcctttgatccctggcaaaaatt

SEQ ID NO: 387514 - DNA, 799 bp, Homo sapiens
  misc_feature (799)..(799): n is a, c, g, or t
ccggcctgtgcgcagttcccgtgccctaggagttggcggcggggcccagccgaggtataagttccacagcttcacccttgtcggtgtgatatgggcgtgaaagaagacataaaacaggcttcccgagtagaacctgccaccccgggctggtggggacgcggcaccaggccgggccgggggaagccgctcggacagtggtccttggtgaagcagagttgccagccatctatggatcctaactaaattggtccttgtaatactcggtattatttgccaagatattgaaaaacctctaaacagtgagaaggaacgaagacaaagatgactgcaattactgcttccattccacattgtactagaagtctggccagcgatttaacggtaagaaagagaaacaaaaggcagctatattgaaacgagaagaagtaacactgacttacttcaaaggcaacataattatttatctagaaaatcagatgaacatttgatctagtaaaaacactactataactaagaacctgttggccagtatacaagatactatctcagtatacaaatttaattttgcttctgtatagtagaaacaatcagagactaaaatacaaggtatagtttataataggataaaaatatgaaacctttaggaataaatttgacaaaattatgcaaaagctgtacatttgaaaactactaatggcgtccaggaaatgctacccccaaatatggcatcttgtcacttcagaaaagtaataaaacctaggaggatccctcttctgaaccttctccaggtcttctcccn

SEQ ID NO: 387515 - DNA, 556 bp, Homo sapiens
ccggcctgtgcgcagttcccgtgccctaggagttggcggcggggcccagccgaggtataagttccacagcttcacccttgtcggtgtgatatgggcgtgaaagaagacataaaacaggcttcccgagtagaacctgccaccccgggctggtggggacgcggcaccaggccgggccgggggaagccgctcggacagtggtccttggaatcttcttcccttctggtctgactaggaaagccagagggagatggtgaaggagacacagagagagtaaaagaacagaccatgcccagcctctccactgcaggagcttggaatcagttcctttctcaggaacctgaccatcaggcctcccagaaagtatcgagaaactgaaacatctcagatcatggcatctggacaatgagacacacctgctgcctgttgaccaactccccttgcttaccccttcgtaactccccactatgtaaaccctttattttagttagcttagacttgtctcccatctctcagctgacatcatctgtaataaagcctttgatccctggcaaaaatt

SEQ ID NO: 387516 - DNA, 248 bp, Homo sapiens
ttaactggggaaggtgtgctactggcatttagtgagtggaggccagggatgctgttaaacatcctacaatggataggatagacttccccacaacaaagaataggccagctcaaaatatcaatagtcgggaaaccctgtattagtctgttcttatgctgctgtgaagaaatacctcagactgggtaatttataaaggaaagaggtttaattgactcacagttctgcatggctggggaggcctcaggaaa
